(12) United States Patent
Walter et al.

(10) Patent No.: US 12,359,234 B2
(45) Date of Patent: Jul. 15, 2025

(54) OLIGOSACCHARIDE PRODUCTION IN YEAST CELLS EXPRESSING AN ABC TRANSPORTER PROTEIN

(71) Applicant: Amyris, Inc., Emeryville, CA (US)

(72) Inventors: Jessica Walter, Emeryville, CA (US); Dominic Pinel, Emeryville, CA (US)

(73) Assignee: Amyris, Inc., Emeryville, CA (US)

( * ) Notice: Subject to any disclaimer, the term of this patent is extended or adjusted under 35 U.S.C. 154(b) by 0 days.

(21) Appl. No.: 17/634,392

(22) PCT Filed: Aug. 13, 2020

(86) PCT No.: PCT/US2020/046227
§ 371 (c)(1),
(2) Date: Feb. 10, 2022

(87) PCT Pub. No.: WO2021/030617
PCT Pub. Date: Feb. 18, 2021

(65) Prior Publication Data
US 2022/0298536 A1    Sep. 22, 2022

Related U.S. Application Data

(60) Provisional application No. 62/886,074, filed on Aug. 13, 2019.

(51) Int. Cl.
*C12P 19/04* (2006.01)
(52) U.S. Cl.
CPC ....... *C12P 19/04* (2013.01); *C12Y 101/01271* (2013.01); *C12Y 204/01069* (2013.01); *C12Y 204/01152* (2013.01); *C12Y 204/99004* (2013.01); *C12Y 205/01057* (2013.01); *C12Y 207/07023* (2013.01); *C12Y 207/07043* (2013.01); *C12Y 306/03* (2013.01); *C12Y 402/01047* (2013.01); *C12Y 501/03014* (2013.01)

(58) Field of Classification Search
None
See application file for complete search history.

(56) References Cited

U.S. PATENT DOCUMENTS

2018/0305724 A1* 10/2018 Jennewein ............. C12P 19/18

FOREIGN PATENT DOCUMENTS

| WO | WO-2010/142305 A1 | 12/2010 |
| WO | WO-2017/042382 A1 | 3/2017 |
| WO | WO-2019/099649 A1 | 5/2019 |

OTHER PUBLICATIONS

Accession A0A0H5C1N2. Oct. 14, 2015 (Year: 2015).*
UniProtKB Database Accession No. A0A0H5C7Z1, <https://www.uniprot.org/uniprot/A0A0H5C7Z1.txt>, retrieved Jan. 31, 2021.
Hollands et al., "Engineering two species of yeast as cell factories for 2'-fucosyllactose," Metab Eng. 52:232-242 (Includes supplemental material) (Mar. 2019) (83 pages).
Database Geneseq "*Saccharomyces cerevisiae* QDR3 protein, SEQ ID 37," retrieved from EBI accession No. GSN: AZQ22518, database accession No. AZQ22518 (Jan. 2012) (1 page).
Database Geneseq "Yeast plakoglobin protein, SEQ ID No. 70," retrieved from EBI accession No. GSN: ARP96668, database accession No. ARP96668 (Nov. 2008) (1 page).
Database Geneseq "Yeast JEN1 protein, SEQ: 241," retrieved from EBI accession No. GSN: BBR03997, database accession No. BBR03997 (Jan. 2015) (1 page).
Extended European Search Report for European Patent Application No. 20853477.6, dated Nov. 17, 2023 (15 pages).

* cited by examiner

*Primary Examiner* — Christian L Fronda
(74) *Attorney, Agent, or Firm* — Clark & Elbing LLP

(57) ABSTRACT

Provided herein are genetically modified yeast cells capable of producing one or more human milk oligosaccharides (HMOs) and methods of making such cells. The yeast cells are engineered to comprise a heterologous nucleic acid encoding a transporter protein and one or more heterologous nucleic acids that encode enzymes of a HMO biosynthetic pathway. Also provided are fermentation compositions including the disclosed genetically modified yeast cells, and related methods of producing and recovering HMOs generated by the yeast cells.

9 Claims, 14 Drawing Sheets

Specification includes a Sequence Listing.

OLIGOSACCHARIDE PRODUCTION IN YEAST CELLS EXPRESSING AN ABC TRANSPORTER PROTEIN

BACKGROUND OF THE INVENTION

Human milk oligosaccharides (HMOs) are the third most abundant component of human milk, with only lactose and lipids present in higher concentrations. More than 200 different species of HMOs have been identified to date in human milk. There is growing evidence attributing various health benefits to these milk compounds. Exemplary benefits include the promotion of the growth of protective intestinal microbes such as bifidobacteria, an increase in protection from gastrointestinal infections, a strengthening of the immune system, and an improvement in cognitive development. Because HMOs are not found in other milk sources, e.g., cow or goat, the only source of HMOs has traditionally been mother's milk. In efforts to improve the nutritional value of infant formula and expand the use of HMOs for child and adult nutrition, there has been an increased interest in the synthetic production of these compounds.

BRIEF SUMMARY OF SOME ASPECTS OF THE INVENTION

The present disclosure is based, at least in part, on the discovery that various adenosine triphosphate (ATP)-binding cassette (ABC) transporter polypeptides exhibit the ability to export human milk oligosaccharides (HMOs) across cell membranes. Moreover, it has presently been discovered that the expression of such a heterologous ABC transporter in a yeast strain that is genetically modified to express one or more HMOs enhances production of the HMO(s) compared to a counterpart yeast strain that is genetically modified to express the one or more HMOs, but that does not express the heterologous ABC transporter. Particularly, it has been discovered that expression of such a heterologous ABC transporter in a yeast cell genetically modified to biosynthesize one or more HMOs not only augments the overall yield of the HMO(s), but also improves the purity of the HMO(s) relative to a counterpart yeast strain modified to biosynthesize the HMO(s) but that lacks the heterologous ABC transporter.

Illustrative ABC transporter polypeptides that may be used in conjunction with the compositions and methods of the disclosure include those having an amino acid sequence that is at least 85% identical to any one of SEQ ID NOS: 1-27, as well as functional variants thereof, as described herein. In some embodiments, the ABC transporter polypeptide comprises the sequence of any one of SEQ ID NO: 1, SEQ ID NO: 2, and SEQ ID NO: 3, or functional variants thereof as described herein. Thus, in certain aspects, provided herein are methods of modifying a host organism to express a transporter polypeptide, compositions comprising such host cells, and methods of using the host cells to enhance production of one or more HMOs.

In one aspect, provided herein is a yeast cell genetically modified to produce one or more HMOs, wherein the yeast cell comprises (i) a heterologous nucleic acid encoding an ABC transporter polypeptide; and (ii) one or more heterologous nucleic acids that each independently encode at least one enzyme of an HMO biosynthetic pathway.

In some embodiments, the ABC transporter exports the human milk oligosaccharide 2'-fucosyllactose. In some embodiments, the ABC transporter polypeptide has at least 95% amino acid sequence identity to any one of SEQ ID NOS: 1-27. In some embodiments, the ABC transporter comprises the amino acid sequence of any one of SEQ ID NOS: 1-27. In some embodiments, the ABC transporter polypeptide comprises an amino acid sequence having at least 95% identity to SEQ ID NO: 1, SEQ ID NO: 2, or SEQ ID NO: 3. In some embodiments, the ABC transporter comprises the amino acid sequence of SEQ ID NO: 1, SEQ ID NO: 2, or SEQ ID NO: 3. In some embodiments, the ABC transporter exports the human milk oligosaccharide lacto-N-neotetraose. In some embodiments, the ABC transporter comprises an amino acid sequence having at least 95% (e.g., 96%, 97%, 98%, or 99%) identity to any one of SEQ ID NOS: 28-98. In some embodiments, the ABC transporter comprises the amino acid sequence of any one of SEQ ID NOS: 28-98. In some embodiments, the ABC transporter comprises an amino acid sequence having at least 95% (e.g., 96%, 97%, 98%, or 99%) identity to any one of SEQ ID NOS: 28-55. In some embodiments, the ABC transporter comprises the amino acid sequence of any one of SEQ ID NOS: 28-55. In some embodiments, the ABC transporter comprises an amino acid sequence having at least 95% (e.g., 96%, 97%, 98%, or 99%) identity to any one of SEQ ID NOS: 28-38 and 55. In some embodiments, the ABC transporter comprises the amino acid sequence of any one of SEQ ID NOS: 28-38 and 55. In some embodiments, the ABC transporter comprises an amino acid sequence having at least 95% (e.g., 96%, 97%, 98%, or 99%) identity to any one of SEQ ID NO: 28, SEQ ID NO: 29, SEQ ID NO: 30, SEQ ID NO: 31, SEQ ID NO: 32, and SEQ ID NO: 55. In some embodiments, the ABC transporter comprises the amino acid sequence of any one of SEQ ID NO: 28, SEQ ID NO: 29, SEQ ID NO: 30, SEQ ID NO: 31, SEQ ID NO: 32, and SEQ ID NO: 55. In some embodiments, the ABC transporter exports the human oligonucleotide 6'-siallylactose. In some embodiments, the ABC transporter comprises an amino acid sequence having at least 95% (e.g., 96%, 97%, 98%, or 99%) identity to any one of SEQ ID NOS: 99-126. In some embodiments, the ABC transporter comprises the amino acid sequence of any one of SEQ ID NOS: 99-126. In some embodiments, the ABC transporter comprises an amino acid sequence having at least 95% (e.g., 96%, 97%, 98%, or 99%) identity to any one of SEQ ID NOS: 99-102. In some embodiments, the ABC transporter comprises the amino acid sequence of any one of SEQ ID NOS: 99-102. In some embodiments, the ABC transporter comprises an amino acid sequence having at least 95% (e.g., 96%, 97%, 98%, or 99%) identity to any one of SEQ ID NOS: 99 and 100. In some embodiments, the ABC transporter comprises the amino acid sequence of any one of SEQ ID NOS: 99 and 100.

In some embodiments, the heterologous nucleic acid encoding the ABC transporter polypeptide is integrated into the genome of the yeast cell and/or the one or more heterologous nucleic acids that each independently encode at least one enzyme of an HMO biosynthetic pathway. In some embodiments, the heterologous nucleic acid encoding the ABC transporter polypeptide and/or the one or more heterologous nucleic acids that each independently encode at least one enzyme of a human milk oligosaccharide biosynthetic pathway are encoded episomally, for example, by one or more plasmids. In some embodiments, the one or more HMOs comprise 2' fucosyllactose; thus, for example, the enzymes encoded by the one or more heterologous nucleic acids that independently encode at least one enzyme of the HMO biosynthetic pathway may comprise one or more of a GDP-mannose 4,6-dehydratase, a GDP-L-fucose synthase, an α-1,2-fucosyltransferase, and a fucosidase. In some embodiments, the one or more HMOs comprise 3-fucosyllactose; thus, for example, the enzymes encoded by the one or more heterologous nucleic acids may comprise one or more of a GDP-mannose 4,6-dehydratase, a GDP-L-fucose synthase, an α-1,3-fucosyltransferase, and a fucosidase. In some embodiments, the one or more HMOs comprise 3-fucosyllactose; thus, for example, the enzymes encoded by the one or more heterologous nucleic acids may comprise one or more of a GDP-mannose 4,6-dehydratase, a GDP-L-fucose synthase, an α-1,3-fucosyltransferase, and a fucosidase. In some embodiments, the one or more HMOs comprise lacto-N-tetraose; thus, for example, the enzymes encoded by the one or more heterologous nucleic acids may comprise one or more of a β-1,3-N-acetylglucosaminyltransferase, a β-1,3-galactosyltransferase, and a UDP-N-acetylglucosamine diphosphorylase. In some embodiments, the one or more HMOs comprise lacto-N-neotetraose; thus, for example the enzymes encoded by the one or more heterologous nucleic acids may comprise one or more of a β-1,3-N-acetylglucosaminyltransferase, a β-1,4-galactosyltransferase, and a UDP-N-acetylglucosamine diphosphorylase. In some embodiments, the one or more HMOs comprise 3'-sialyllactose; thus, for example, the enzymes encoded by the one or more heterologous nucleic acids may comprise one or more of a CMP-Neu5Ac synthetase, a sialic acid synthase, a UDP-N-acetylglucosamine 2-epimerase, a UDP-N-acetylglucosamine diphosphorylase, and a CMP-N-acetylneuraminate-β-galactosamide-α-2,3-sialyltransferase. In some embodiments, the one or more HMOs comprise 6'-sialyllactose; thus, for example, the enzymes encoded by the one or more heterologous nucleic acids may comprise one or more of a CMP-Neu5Ac synthetase, a sialic acid synthase, a UDP-N-acetylglucosamine 2-epimerase, a UDP-N-acetylglucosamine diphosphorylase, and a β-galactoside-α-2,6-sialyltransferase. In some embodiments, the one or more HMOs comprise difucosyllactose; thus, for example, the enzymes encoded by the one or more heterologous nucleic acids may comprise one or more of a GDP-mannose 4,6-dehydratase, a GDP-L-fucose synthase, an α-1,2-fucosyltransferase, and an α-1,3-fucosyltransferase.

In some embodiments, expression of the heterologous nucleic acid of (i), encoding the ABC transporter polypeptide, and/or expression of the at least one heterologous nucleic acid of (ii), encoding at least one enzyme of an HMO biosynthetic pathway, is driven by an inducible promoter or is negatively regulated by the activity of a promoter that is responsive to a small molecule.

In some embodiments, the yeast cell further comprises a heterologous nucleic acid encoding a protein that transports lactose into the yeast cell. In some embodiments, the protein is a lactose permease. In some embodiments, the protein is a lactose transporter.

In some embodiments, the yeast cell is a *Saccharomyces* sp. or a *Kluveromyces* sp. In some embodiments, the yeast cell is a *Kluveromyces* sp cell.

In some embodiments, the yeast cell is a *Saccharomyces cerevisiae* cell, which in particular embodiments, may comprise a heterologous nucleic acid encoding a lactose permease.

In some embodiments, the yeast cell is a *Kluveromyces marxianus* cell, which in particular embodiments, may further comprises a deletion of at least a portion of a nucleic acid encoding β-galactosidase.

In a further aspect, the disclosure provides a method of producing one or more HMOs, the method comprising culturing a population of genetically modified yeast cells as described herein, e.g., in any of the preceding paragraphs, in a culture medium under conditions suitable for the yeast cells to produce the one or more HMOs. In some embodiments, the culture medium comprises sucrose and lactose, wherein, for example, the mass ratio of the sucrose to the lactose is less than 40. In some embodiments, the method comprises, prior to the culturing, growing the population of genetically modified yeast cells in a growth medium comprising a small molecule, wherein, for example, expression of at least one of the one or more nucleic acids is negatively regulated by the activity of a promoter responsive to the small molecule, and wherein, for example, the concentration of the small molecule in the culture medium during the culturing is sufficiently low that the promoter is no longer active. In some embodiments, the method further comprises adjusting the mass ratio of the sucrose to the lactose, thereby altering the production of at least one of the one or more HMOs.

In an additional aspect, provided herein is a fermentation composition comprising a population of genetically modified yeast cells comprising the yeast cell as described herein, e.g., as described above, and a culture medium comprising one or more HMOs produced from the yeast cells. One or more HMOs may be recovered from the fermentation composition. In some embodiments, the method of recovering the one or more HMOs from the fermentation composition comprises separating at least a portion of the population of genetically modified yeast cells from the culture medium; contacting the separated yeast cells with a heated aqueous wash liquid; and removing the wash liquid from the separated yeast cells. In some embodiments, the heated aqueous wash liquid has a temperature greater than 48° C. In some embodiments, one or both of the separating and removing steps comprise centrifugation. In some embodiments, the culture medium and the wash liquid together comprise at least 70% by mass of at least one of the one or more HMOs produced from the yeast cells.

In a further aspect, provided herein is a method of genetically modifying a yeast cell to produce one or more HMOs, the method comprising: (a) (i) introducing a heterologous nucleic acid encoding an ABC transporter; and (ii) introducing one or more heterologous nucleic acids that each independently encode at least one enzyme of a HMO biosynthetic pathway into the yeast cell; or (b) introducing a heterologous nucleic acid encoding an ABC transporter polypeptide into the yeast cell, wherein the yeast cell comprises one or more heterologous nucleic acids that each independently encode at least one enzyme of a HMO biosynthetic pathway into the yeast cell. In some embodiments, the ABC transporter exports 2'-fucosyllactose. In some embodiments, the ABC transporter has an amino acid sequence having at least 95% (e.g., 96%, 97%, 98%, or 99%) identity to any one of SEQ ID NOS: 1-27. In some embodiments, the ABC transporter comprises the amino acid sequence of any one of SEQ ID NOS: 1-27. In some embodiments, the ABC transporter polypeptide comprises an amino acid sequence having at least 95% identity to SEQ ID NO: 1, SEQ ID NO: 2, or SEQ ID NO: 3. In some embodiments, the ABC transporter comprises the amino acid sequence of SEQ ID NO: 1, SEQ ID NO: 2, or SEQ ID NO: 3. In some embodiments, the ABC transporter exports lacto-N-neotetraose. In some embodiments, the ABC transporter comprises an amino acid sequence having at least 95% (e.g., 96%, 97%, 98%, or 99%) identity to any one of SEQ ID NOS: 28-98. In some embodiments, the ABC transporter comprises the amino acid sequence of any one of SEQ ID NOS: 28-98. In some embodiments, the ABC transporter comprises an amino acid sequence having at least 95% (e.g., 96%, 97%, 98%, or 99%) identity to any one of SEQ ID NOS: 28-55. In some embodiments, the ABC transporter comprises the amino acid sequence of any one of SEQ ID NOS: 28-55. In some embodiments, the ABC transporter comprises an amino acid sequence having at least 95% (e.g., 96%, 97%, 98%, or 99%) identity to any one of SEQ ID NOS: 28-38 and 55. In some embodiments, the ABC transporter comprises the amino acid sequence of any one of SEQ ID NOS: 28-38 and 55. In some embodiments, the ABC transporter comprises an amino acid sequence having at least 95% (e.g., 96%, 97%, 98%, or 99%) identity to any one of SEQ ID NO: 28, SEQ ID NO: 29, SEQ ID NO: 30, SEQ ID NO: 31, SEQ ID NO: 32, and SEQ ID NO: 55. In some embodiments, the ABC transporter comprises the amino acid sequence of any one of SEQ ID NO: 28, SEQ ID NO: 29, SEQ ID NO: 30, SEQ ID NO: 31, SEQ ID NO: 32, and SEQ ID NO: 55. In some embodiments, the ABC transporter exports 6'-siallylactose. In some embodiments, the ABC transporter comprises an amino acid sequence having at least 95% (e.g., 96%, 97%, 98%, or 99%) identity to any one of SEQ ID NOS: 99-126. In some embodiments, the ABC transporter comprises the amino acid sequence of any one of SEQ ID NOS: 99-126. In some embodiments, the ABC transporter comprises an amino acid sequence having at least 95% (e.g., 96%, 97%, 98%, or 99%) identity to any one of SEQ ID NOS: 99-102. In some embodiments, the ABC transporter comprises the amino acid sequence of any one of SEQ ID NOS: 99-102. In some embodiments, the ABC transporter comprises an amino acid sequence having at least 95% (e.g., 96%, 97%, 98%, or 99%) identity to any one of SEQ ID NOS: 99 and 100. In some embodiments, the ABC transporter comprises the amino acid sequence of any one of SEQ ID NOS: 99 and 100.

In some embodiments, the heterologous nucleic acid encoding the ABC transporter polypeptide is integrated into the genome of the yeast cell and/or the one or more heterologous nucleic acids that each independently encode at least one enzyme of a HMO biosynthetic pathway is integrated into the genome of the yeast cell. In some embodiments, the heterologous nucleic acid encoding the ABC transporter polypeptide and/or the one or more heterologous nucleic acids that each independently encode at least one enzyme of a human milk oligosaccharide biosynthetic pathway are encoded episomally, for example, by one or more plasmids. In some embodiments, the one or more HMOs comprise 2' fucosyllactose; and thus, for example, the enzymes encoded by the one or more heterologous nucleic acids that independently encode at least one enzyme of the HMO biosynthetic pathway may comprise one or more of a GDP-mannose 4,6-dehydratase, a GDP-L-fucose synthase, an α-1,2-fucosyltransferase, and a fucosidase. In some embodiments, the one or more HMOs comprise 3-fucosyllactose; and thus, for example, the enzymes encoded by the one or more heterologous nucleic acids comprise one or more of a GDP-mannose 4,6-dehydratase, a GDP-L-fucose synthase, an α-1,3-fucosyltransferase, and a fucosidase. In some embodiments, the one or more HMOs comprise lacto-N-tetraose; and thus, for example the enzymes encoded by the one or more heterologous nucleic acids comprise one or more of a β-1,3-N-acetylglucosaminyltransferase, a β-1,3-galactosyltransferase, and a UDP-N-acetylglucosamine diphosphorylase. In some embodiments, the one or more HMOs comprise lacto-N-neotetraose; and thus, for example the enzymes encoded by the one or more heterologous nucleic acids comprise one or more of a β-1,3-N-acetylglucosaminyltransferase, a β-1,4-galactosyltransferase, and a UDP-N-acetylglucosamine diphosphorylase. In some embodiments, the one or more HMOs comprise 3'-sialyllactose; and thus, for example, the enzymes encoded by the one or more heterologous nucleic acids comprise one or more of a CMP-Neu5Ac synthetase, a sialic acid synthase, a UDP-N-acetylglucosamine 2-epimerase, a UDP-N-acetylglucosamine diphosphorylase, and a CMP-N-acetylneuraminate-β-galactosamide-α-2,3-sialyltransferase. In some embodiments, the one or more HMOs comprise 6'-sialyllactose; and thus, for example, the enzymes encoded by the one or more heterologous nucleic acids comprise one or more of a CMP-Neu5Ac synthetase, a sialic acid synthase, a UDP-N-acetylglucosamine 2-epimerase, a UDP-N-acetylglucosamine diphosphorylase, and a β-galactoside-α-2,6-sialyltransferase. In some embodiments, the one or more HMOs comprise difucosyllactose. In some embodiments, the one or more HMOs comprise difucosyllactose and the enzymes encoded by the one or more heterologous nucleic acids comprise one or more of a GDP-mannose 4,6-dehydratase, a GDP-L-fucose synthase, an α-1,2-fucosyltransferase, and an α-1,3-fucosyltransferase. In some embodiments, expression of the heterologous nucleic acid encoding the ABC transporter is driven by an inducible promoter or is negatively regulated by the activity of a promoter that is responsive to a small molecule. In some embodiments, expression of the enzymes encoded by the one or more heterologous nucleic acids is driven by an inducible promoter or is negatively regulated by the activity of a promoter that is responsive to a small molecule.

In some embodiments, the yeast cell is a *Saccharomyces* sp. or a *Kluveromyces* sp. In some embodiments, the yeast cell is a *Saccharomyces cerevisiae* cell. In some embodiments, the enzymes encoded by the one or more heterologous nucleic acids further comprise a lactose transporter or a lactose permease. In some embodiments, the yeast cell is a *Kluveromyces marxianus* cell. In some embodiments, the yeast cell is a *Saccharomyces cerevisiae* cell, which in particular embodiments, may comprise a heterologous nucleic acid encoding a lactose permease. In some embodiments, the yeast cell is a *Kluveromyces marxianus* cell, which in particular embodiments, may further comprises a deletion of at least a portion of a nucleic acid encoding β-galactosidase.

DETAILED DESCRIPTION OF THE INVENTION

Terminology

Figure 1:
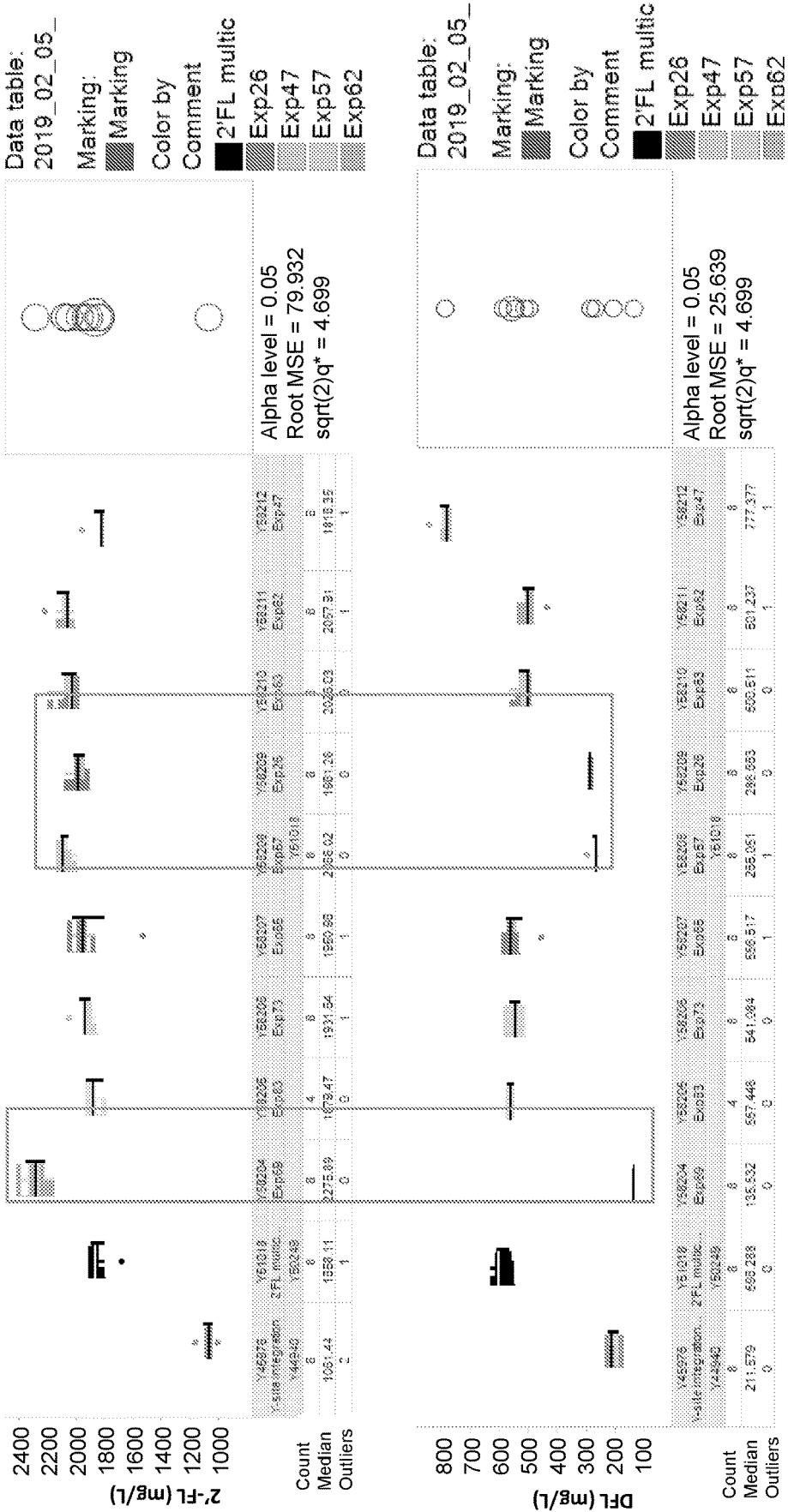
FIG. 1 provides data illustrating exporter activity of candidate transporter proteins. The parent strain that undergoes modification to express candidate transporter proteins is Y51018.

As used in the context of the present disclosure, "a human milk oligosaccharide ABC transporter polypeptide," also referred to herein as an "HMO ABC transporter" or an "HMO transporter," refers to an ATP-binding cassette (ABC) transporter polypeptide that has been presently discovered to increase export of one or more HMOs produced by recombinant yeast cells that are engineered to express one or more enzymes of an HMO biosynthesis pathway. The terms "human milk oligosaccharide ABC transporter polypeptide" and "HMO ABC transporter" encompass biologically active variants, alleles, mutants, and interspecies homologs to the specific polypeptides described herein. A nucleic acid that encodes an HMO ABC transporter polypeptide, e.g., SEQ ID NO: 1, 2, or 3; any one of SEQ ID NOS: 4-27, or any one of SEQ ID NOS: 28-98, refers to a gene, pre-mRNA, mRNA, and the like, including nucleic acids encoding variants, alleles, mutants, and interspecies homologs of the particular amino acid sequences described herein, e.g., SEQ ID NOS: 1-3; any one of SEQ ID NOS: 4-27, any one of SEQ ID NOS: 28-98; or any one of SEQ ID NOS: 99-126.

The terms "ABC transporter" and "ATP-binding cassette transporter" as used herein refer to proteins that are members of a large superfamily found in all kingdoms of life, which are responsible for the transport of compounds, such as drugs, ions, metabolites, lipids, vitamins, and organic compounds (e.g., HMOs), across cell membranes. ABC transporters that act as exporters can transport these compounds outward from the cytoplasm into the extracellular environment, while importers transport compounds into the cytoplasm.

The terms "human milk oligosaccharide" and "HMO" are used herein to refer to a group of nearly 200 identified sugar molecules that are found as the third most abundant component in human breast milk. HMOs in human breast milk are a complex mixture of free, indigestible carbohydrates with many different biological roles, including promoting the development of a functional infant immune system. HMOs include, without limitation, oligosaccharides that are fucosylated, such as 2'-fucosyllactose, 3-fucosyllactose, and difucosyllactose; galactosylated; sialylated; such as 3'-sialyllactose and 6'-sialyllactose; glycosylated; are neutral, such as lacto-N-tetraose and lacto-N-neotetraose; and may also include glucose, galactose, sialic acid, or N-acetylglucosamine.

The terms "polynucleotide" and "nucleic acid" are used interchangeably and refer to a single or double-stranded polymer of deoxyribonucleotide or ribonucleotide bases read from the 5' to the 3' end. A nucleic acid as used in the present invention will generally contain phosphodiester bonds, although in some cases, nucleic acid analogs may be used that may have alternate backbones, comprising, e.g., phosphoramidate, phosphorothioate, phosphorodithioate, or O-methylphosphoroamidite linkages (see Eckstein, Oligonucleotides and Analogues: A Practical Approach, Oxford University Press); positive backbones; non-ionic backbones, and non-ribose backbones. Nucleic acids or polynucleotides may also include modified nucleotides that permit correct read-through by a polymerase. "Polynucleotide sequence" or "nucleic acid sequence" includes both the sense and antisense strands of a nucleic acid as either individual single strands or in a duplex. As will be appreciated by those in the art, the depiction of a single strand also defines the sequence of the complementary strand; thus, the sequences described herein also provide the complement of the sequence. Unless otherwise indicated, a particular nucleic acid sequence also implicitly encompasses variants thereof (e.g., degenerate codon substitutions) and complementary sequences, as well as the sequence explicitly indicated. The nucleic acid may be DNA, both genomic and cDNA, RNA, or a hybrid, in which the nucleic acid may contain combinations of deoxyribo- and ribo-nucleotides, and combinations of bases, including uracil, adenine, thymine, cytosine, guanine, inosine, xanthine hypoxanthine, isocytosine, isoguanine, etc. Nucleic acid sequences are presented in the 5' to 3' direction unless otherwise specified.

As used herein, the terms "polypeptide," "peptide," and "protein" are used interchangeably to refer to a polymer of amino acid residues. The terms encompass amino acid chains of any length, including full-length proteins, wherein the amino acid residues are linked by covalent peptide bonds.

"Percent (%) sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

An exemplary algorithm that may be used to determine whether a polypeptide has sequence identity to any one of SEQ ID NO: 1, SEQ ID NO: 2, SEQ ID NO: 3, SEQ ID NOS: 28-32, and SEQ ID NO: 55, or to another polypeptide reference sequence, such as any one of SEQ ID NOS: 4-27, 32-54, 56-98, and 99-126, is the BLAST algorithm, which is described in Altschul et al., 1990, J. Mol. Biol. 215:403-410, which is incorporated herein by reference. Software for performing BLAST analyses is publicly available through the National Center for Biotechnology Information (on the worldwide web at ncbi.nlm.nih.gov/). For amino acid sequences, the BLASTP program uses as defaults a word size (W) of 3, an expectation (E) of 10, and the BLOSUM62 scoring matrix (see Henikoff & Henikoff, 1989, Proc. Natl. Acad. Sci. USA 89:10915). Other programs that may be used include the Needleman-Wunsch procedure, J. Mol. Biol. 48: 443-453 (1970), using BLOSUM62, a Gap start penalty of 7 and gap extend penalty of 1; and gapped BLAST 2.0 (see Altschul, et al. 1997, Nucleic Acids Res., 25:3389-3402). Although various algorithms can be employed to determine percent identity, for purposes herein, % amino acid sequence identity values are generated using the sequence comparison computer program BLASTP (protein-protein BLAST algorithm) using default parameters.

Two sequences are "substantially identical" if two sequences have a specified percentage of amino acid residues or nucleotides that are the same (i.e., 60% identity, optionally 65%, 70%, 75%, 80%, 85%, 90%, 95%, or 99% identity over a specified region, or, when not specified, over the entire sequence), when compared and aligned for maximum correspondence over a comparison window, or designated region as measured using one of the following a sequence comparison algorithm or by manual alignment and visual inspection as described above. Optionally, the identity exists over a region that is at least about 50 nucleotides (or 20 amino acids) in length, or more preferably over a region that is 100 to 500 or 1000 or more nucleotides (or 50, 100, or 200 or more amino acids) in length.

Nucleic acid or protein sequences that are substantially identical to a reference sequence include "conservatively modified variants." With respect to particular nucleic acid sequences, conservatively modified variants refer to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine) can be modified to yield a functionally identical molecule. Accordingly, each silent variation of a nucleic acid which encodes a polypeptide is implicit in each described sequence.

As to amino acid sequences, one of skill will recognize that individual substitutions, in a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Examples of amino acid groups defined in this manner can include: a "charged/polar group" including Glu (Glutamic acid or E), Asp (Aspartic acid or D), Asn (Asparagine or N), Gln (Glutamine or Q), Lys (Lysine or K), Arg (Arginine or R) and His (Histidine or H); an "aromatic or cyclic group" including Pro (Proline or P), Phe (Phenylalanine or F), Tyr (Tyrosine or Y) and Trp (Tryptophan or W); and an "aliphatic group" including Gly (Glycine or G), Ala (Alanine or A), Val (Valine or V), Leu (Leucine or L), Ile (Isoleucine or I), Met (Methionine or M), Ser (Serine or S), Thr (Threonine or T) and Cys (Cysteine or C). Within each group, subgroups can also be identified. For example, at pH 7, the group of charged/polar amino acids can be sub-divided into sub-groups including: the "positively-charged sub-group" comprising Lys, Arg and His; the "negatively-charged sub-group" comprising Glu and Asp; and the "polar sub-group" comprising Asn and Gln. In another example, the aromatic or cyclic group can be sub-divided into sub-groups including: the "nitrogen ring sub-group" comprising Pro, His and Trp; and the "phenyl sub-group" comprising Phe and Tyr. In another further example, the aliphatic group can be sub-divided into sub-groups including: the "large aliphatic non-polar sub-group" comprising Val, Leu, and Ile; the "aliphatic slightly-polar sub-group" comprising Met, Ser, Thr and Cys; and the "small-residue sub-group" comprising Gly and Ala. Examples of conservative mutations include amino acid substitutions of amino acids within the sub-groups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH$_2$ can be maintained. The following six groups each contain amino acids that further provide illustrative conservative substitutions for one another. 1) Ala, Ser, Thr; 2) Asp, Glu; 3) Asn, Gln; 4) Arg, Lys; 5) Ile, Leu, Met, Val; and 6) Phe, Try, and Trp (see, e.g., Creighton, Proteins (1984)).

As used herein the term "heterologous" refers to what is not normally found in nature. The term "heterologous nucleic acid" refers to a nucleic acid not normally found in a given cell in nature. A heterologous nucleic acid can be: (a) foreign to its host cell, i.e., exogenous to the host cell such that a host cell does not naturally contain the nucleic acid; (b) naturally found in the host cell, i.e., endogenous or native to the host cell, but present at an unnatural quantity in the cell (i.e., greater or lesser quantity than naturally found in the host cell); (c) be naturally found in the host cell but positioned outside of its natural locus. A "heterologous" polypeptide refers to a polypeptide that is encoded by a "heterologous nucleic acid". Thus, for example, a "heterologous" polypeptide may be naturally produced by a host cell but is encoded by a heterologous nucleic acid that has been introduced into the host cell by genetic engineering. For example, a "heterologous" polypeptide can include embodiments in which an endogenous polypeptide is produced by an expression construct and is overexpressed in the host cell compared to native levels of the polypeptide produced by the host cell.

As used herein, the term "introducing" in the context of introducing a nucleic acid or protein into a host cell refers to any process that results in the presence of a heterologous nucleic acid or polypeptide inside the host cell. For example, the term encompasses introducing a nucleic acid molecule (e.g., a plasmid or a linear nucleic acid) that encodes the nucleic acid of interest (e.g., an RNA molecule) or polypeptide of interest and results in the transcription of the RNA molecules and translation of the polypeptides. The term also encompasses integrating the nucleic acid encoding the RNA molecules or polypeptides into the genome of a progenitor cell. The nucleic acid is then passed through subsequent generations to the host cell, so that, for example, a nucleic acid encoding an RNA-guided endonuclease is "pre-integrated" into the host cell genome. In some cases, introducing refers to translocation of a nucleic acid or polypeptide from outside the host cell to inside the host cell. Various methods of introducing nucleic acids, polypeptides and other biomolecules into host cells are contemplated, including but not limited to, electroporation, contact with nanowires or nanotubes, spheroplasting, PEG 1000-mediated transformation, biolistics, lithium acetate transformation, lithium chloride transformation, and the like.

As used herein, the term "transformation" refers to a genetic alteration of a host cell resulting from the introduction of exogenous genetic material, e.g., nucleic acids, into the host cell.

As used herein, the term "gene" refers to the segment of DNA involved in producing or encoding a polypeptide chain. It may include regions preceding and following the coding region (leader and trailer) as well as intervening sequences (introns) between individual coding segments (exons). Alternatively, the term "gene" can refer to the segment of DNA involved in producing or encoding a non-translated RNA, such as an rRNA, tRNA, gRNA, or micro RNA.

The term "expression cassette" or "expression construct" refers to a nucleic acid construct that, when introduced into a host cell, results in transcription and/or translation of an RNA or polypeptide, respectively. In the case of expression of transgenes, one of skill will recognize that the inserted polynucleotide sequence need not be identical but may be only substantially identical to a sequence of the gene from which it was derived. As explained herein, these substantially identical variants are specifically covered by reference to a specific nucleic acid sequence. One example of an expression cassette is a polynucleotide construct that comprises a polynucleotide sequence encoding a polypeptide for use in the invention operably linked to a promoter, e.g., its native promoter, where the expression cassette is introduced into a heterologous microorganism. In some embodiments, an expression cassette comprises a polynucleotide sequence encoding a polypeptide of the invention where the polynucleotide that is targeted to a position in the genome of a microorganism such that expression of the polynucleotide sequence is driven by a promoter that is present in the microorganism.

The term "host cell" as used in the context of this invention refers to a microorganism, such as yeast, and includes an individual cell or cell culture comprising a heterologous vector or heterologous polynucleotide as described herein. Host cells include progeny of a single host cell, and the progeny may not necessarily be completely identical (in morphology or in total DNA complement) to the original parent cell due to natural, accidental, or deliberate mutation and/or change. A host cell includes cells into which a recombinant vector or a heterologous polynucleotide of the invention has been introduced, including by transformation, transfection, and the like.

As used herein, the term "promoter" refers to a nucleic acid control sequences that can direct transcription of a nucleic acid. A promoter includes necessary nucleic acid sequences near the start site of transcription. A promoter also optionally includes distal enhancer or repressor elements, which can be located as much as several thousand base pairs from the start site of transcription.

As used herein, the term "genetic switch" refers to one or more genetic elements that allow controlled expression of enzymes, e.g., enzymes that catalyze the reactions of human milk oligosaccharide biosynthesis pathways. For example, a genetic switch can include one or more promoters operably linked to one or more genes encoding a biosynthetic enzyme, or one or more promoters operably linked to a transcriptional regulator which regulates expression one or more biosynthetic enzymes.

As used herein, the term "operably linked" refers to a functional linkage between nucleic acid sequences such that the sequences encode a desired function. For example, a coding sequence for a gene of interest, e.g., an ABC HMO transporter polypeptide, is in operable linkage with its promoter and/or regulatory sequences when the linked promoter and/or regulatory region functionally controls expression of the coding sequence. It also refers to the linkage between coding sequences such that they may be controlled by the same linked promoter and/or regulatory region; such linkage between coding sequences may also be referred to as being linked in frame or in the same coding frame. "Operably linked" also refers to a linkage of functional but non-coding sequences, such as an autonomous propagation sequence or origin of replication. Such sequences are in operable linkage when they are able to perform their normal function, e.g., enabling the replication, propagation, and/or segregation of a vector bearing the sequence in a host cell.

The term "enhanced" in the context of increased production of one or more HMOs from a genetically modified yeast as described herein refers to an increase in the production of at least one HMO by a host cell genetically modified to express an ABC transporter described herein, for example, an ABC transporter of SEQ ID NO: 1, 2, 3, 28, 29, 30, 31, 32, or 55, or a functional variant thereof; or an ABC transporter of any one of SEQ ID NOS: 4-27, 33-54, 56-98, and 99-126, or a functional variant thereof; in comparison to a control counterpart yeast cell that produced the at least one HMO, but does not have the genetic modification to expression the ABC transporter. Production of at least one HMO is typically enhanced by at least 5%, or at least 10%, 20%, 30%, 40%, 50%, 60%, 70%, 80%, 90%, 100%, or greater compared to the control cell.

As used herein with respect to expression of a non-native ABC transporter polypeptide in a host cell that does not naturally express the ABC transporter polypeptide, the terms "expression" and "overexpression" are used interchangeably.

As used in this specification and the appended claims, the singular forms "a," "an," and "the" include plural reference unless the context clearly dictates otherwise.

As used herein, the term "about" is used herein to mean a value that is ±10% of the recited value.

Modifications to Yeast Cells to Enhance Production of One or More HMOs
Overview
ABC Transporters ATP binding cassette (ABC) transporter polypeptides, referred to as "ABC" transporters, are widespread in all forms of life and are characterized by two nucleotide-binding domains (NBD) and two transmembrane domains (TMDs). ABC transporters function to transport compounds such as drugs, ions, metabolites, lipids, vitamins, and organic compounds across a cell membrane. Without being limited by mechanism or theory, transport is generally driven by ATP hydrolysis on the NBD, causing conformational changes in the TMD. This results in alternating access from inside and outside of the cell for unidirectional transport across the lipid bilayer. Common to all ABC transporters is a signature sequence or motif, LSGGQ, that is involved in nucleotide binding. The majority of eukaryotic ABC transporter family members function in the direction of exporting compounds from the cytoplasmic side of the membrane outward. As a result, ABC transporters may be heterologously expressed to export compounds from a cell, such as a yeast cell. X-ray crystal structure determination of a variety of bacterial and eukaryotic ABC transporters has advanced understanding of the ATP hydrolysis-driven transport mechanism.

Human Milk Oligosaccharide (HMO) ABC Transporters

ABC transporters may exhibit substrate specificity, acting primarily on one particular substrate or a structural variant thereof. The substrate specificity of an ABC transporter is dictated by the structure and amino acid sequence of the ABC transporter. It has presently been discovered that some ABC transporters are able to export HMOs across cell membranes. Thus, the present disclosure provides ABC transporters that have now been discovered to have HMO transporter properties. The ABC transporters provided herein give rise to beneficial biosynthetic properties, as these transporters have been presently discovered to not only engender heightened HMO production, but also improved HMO product purity. Thus, the ABC transporters provided herein may be heterologously expressed in yeast cells to increase export of one or more HMOs produced by recombinant yeast cells that are engineered to express one or more enzymes of a HMO biosynthesis pathway.

Illustrative ABC transporter polypeptide sequences that may be used in conjunction with the compositions and methods described herein include, without limitation, SEQ ID NO: 1, SEQ ID NO: 2, SEQ ID NO: 3, SEQ ID NO: 28, SEQ ID NO: 29, SEQ ID NO: 30, SEQ ID NO: 31, SEQ ID NO: 32, SEQ ID NO: 55, SEQ ID NO: 99, or SEQ ID NO: 100, and functional variants thereof. Additional illustrative ABC transporter polypeptide sequences are SEQ ID NOS: 4-27, 33-54, 56-98, and 101-126, or functional variants thereof.

In some embodiments, a yeast host cell is genetically modified in accordance with the invention to express an ABC transporter polypeptide having an amino acid sequence of any one of SEQ ID NOS: 1-27, or a biologically active variant that shares substantial identity with any one of SEQ ID NOS: 1-27. In some embodiments, the variant has at least 70%, or at least 75%, 80%, or 85% identity to any one of SEQ ID NOS: 1-27. In some embodiments, the variant has at least 90%, or at least 91%, 92%, 93%, or 94% identity to the amino acid sequence of any one of SEQ ID NOS: 1-27. In some embodiments, the variant has at least 95% identity to any one of SEQ ID NOS: 1-27. As used herein, the term "variant" encompasses biologically active polypeptides having one or more substitutions, deletions, or insertions relative to any one of SEQ ID NOS: 1-27. Thus, the term "variant" includes biologically active fragments as well as substitution variants.

In some embodiments, a yeast host cell is genetically modified in accordance with the invention to express an ABC transporter polypeptide having an amino acid sequence of any one of SEQ ID NOS: 28-98, or a biologically active variant that shares substantial identity with any one of SEQ ID NOS: 28-98. In some embodiments, the variant has at least 70%, or at least 75%, 80%, or 85% identity to any one of SEQ ID NOS: 28-100. In some embodiments, the variant has at least 90%, or at least 91%, 92%, 93%, or 94% identity to the amino acid sequence of any one of SEQ ID NOS: 28-98. In some embodiments, the variant has at least 95% identity to any one of SEQ ID NOS: 28-98. As used herein, the term "variant" encompasses biologically active polypeptides having one or more substitutions, deletions, or insertions relative to any one of SEQ ID NOS: 28-98. Thus, the term "variant" includes biologically active fragments as well as substitution variants.

In some embodiments, a yeast host cell is genetically modified in accordance with the invention to express an ABC transporter polypeptide having an amino acid sequence of any one of SEQ ID NOS: 28-55, or a biologically active variant that shares substantial identity with any one of SEQ ID NO: 28-55. In some embodiments, the variant has at least 70%, or at least 75%, 80%, or 85% identity to any one of SEQ ID NOS: 28-55. In some embodiments, the variant has at least 90%, or at least 91%, 92%, 93%, or 94% identity to the amino acid sequence of any one of SEQ ID NOS: 28-55. In some embodiments, the variant has at least 95% identity to any one of SEQ ID NOS: 28-55. As used herein, the term "variant" encompasses biologically active polypeptides having one or more substitutions, deletions, or insertions relative to any one of SEQ ID NO: 28-55. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 1, or a biologically active variant that shares substantial identity with SEQ ID NO: 1. In some embodiments, the variant has at least 70%, or at least 75%, 80%, or 85% identity to SEQ ID NO: 1. In some embodiments, the variant has at least 90%, or at least 91%, 92%, 93%, or 94% identity to the amino acid sequence of SEQ ID NO: 1. In some embodiments, the variant has at least 95% identity to SEQ ID NO: 1. As used herein, the term "variant" encompasses biologically active polypeptides having one or more substitutions, deletions, or insertions relative to SEQ ID NO: 1. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 2, or a biologically active variant that shares substantial identity with SEQ ID NO: 2. In some embodiments, the variant has at least 70%, or at least 75%, 80%, or 85% identity to SEQ ID NO: 2. In some embodiments, the variant has at least 90%, or at least 91%, 92%, 93%, or 94% identity to the amino acid sequence of SEQ ID NO: 2. In some embodiments, the variant has at least 95% identity to SEQ ID NO: 2. As used herein, the term "variant" encompasses biologically active polypeptides having one or more substitutions, deletions, or insertions relative to SEQ ID NO: 2. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 3, or a biologically active variant that shares substantial identity with SEQ ID NO: 3. In some embodiments, the variant has at least 70%, or at least 75%, 80%, or 85% identity to SEQ ID NO: 3. In some embodiments, the variant has at least 90%, or at least 91%, 92%, 93%, or 94% identity to the amino acid sequence of SEQ ID NO: 3. In some embodiments, the variant has at least 95% identity to SEQ ID NO:3. As used herein, the term "variant" encompasses biologically active polypeptides having one or more substitutions, deletions, or insertions relative to SEQ ID NO: 3. Thus, the term "variant" includes biologically active fragments as well as substitution variants.

In some embodiments, a yeast host cell is genetically modified in accordance with the invention to express an ABC transporter polypeptide having the amino acid sequence of any one of SEQ ID NOS: 4-27, or a biologically active variant that shares substantial identity with any one of SEQ ID NOS: 4-27. In some embodiments, the variant has at least 70%, or at least 75%, 80%, or 85% identity to any one of SEQ ID NOS: 4-27. In some embodiments, the variant has at least 90%, or at least 91%, 92%, 93%, or 94% identity to the amino acid sequence of any one of SEQ ID NOS: 4-27. In some embodiments, the variant has at least 95% identity to of any one of SEQ ID NOS: 4-27. As used herein, the term "variant" encompasses biologically active polypeptides having one or more substitutions, deletions, or insertions relative to any one of SEQ ID NOS: 4-27. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 28, or a biologically active variant that shares substantial identity with SEQ ID NO: 28. In some embodiments, the variant has at least 70%, or at least 75%, 80%, or 85% identity to SEQ ID NO: 28. In some embodiments, the variant has at least 90%, or at least 91%, 92%, 93%, or 94% identity to the amino acid sequence of SEQ ID NO: 28. In some embodiments, the variant has at least 95% identity to SEQ ID NO: 28. As used herein, the term "variant" encompasses biologically active polypeptides having one or more substitutions, deletions, or insertions relative to SEQ ID NO: 28. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 29, or a biologically active variant that shares substantial identity with SEQ ID NO: 29. In some embodiments, the variant has at least 70%, or at least 75%, 80%, or 85% identity to SEQ ID NO: 29. In some embodiments, the variant has at least 90%, or at least 91%, 92%, 93%, or 94% identity to the amino acid sequence of SEQ ID NO: 29. In some embodiments, the variant has at least 95% identity to SEQ ID NO: 29. As used herein, the term "variant" encompasses biologically active polypeptides having one or more substitutions, deletions, or insertions relative to SEQ ID NO: 29. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 30, or a biologically active variant that shares substantial identity with SEQ ID NO: 30. In some embodiments, the variant has at least 70%, or at least 75%, 80%, or 85% identity to SEQ ID NO: 30. In some embodiments, the variant has at least 90%, or at least 91%, 92%, 93%, or 94% identity to the amino acid sequence of SEQ ID NO: 30. In some embodiments, the variant has at least 95% identity to SEQ ID NO: 30. As used herein, the term "variant" encompasses biologically active polypeptides having one or more substitutions, deletions, or insertions relative to SEQ ID NO: 30. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 31, or a biologically active variant that shares substantial identity with SEQ ID NO: 31. In some embodiments, the variant has at least 70%, or at least 75%, 80%, or 85% identity to SEQ ID NO: 31. In some embodiments, the variant has at least 90%, or at least 91%, 92%, 93%, or 94% identity to the amino acid sequence of SEQ ID NO: 31. In some embodiments, the variant has at least 95% identity to SEQ ID NO: 31. As used herein, the term "variant" encompasses biologically active polypeptides having one or more substitutions, deletions, or insertions relative to SEQ ID NO: 31. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 32, or a biologically active variant that shares substantial identity with SEQ ID NO: 32. In some embodiments, the variant has at least 70%, or at least 75%, 80%, or 85% identity to SEQ ID NO: 32. In some embodiments, the variant has at least 90%, or at least 91%, 92%, 93%, or 94% identity to the amino acid sequence of SEQ ID NO: 32. In some embodiments, the variant has at least 95% identity to SEQ ID NO: 32. As used herein, the term "variant" encompasses biologically active polypeptides having one or more substitutions, deletions, or insertions relative to SEQ ID NO: 32. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 55, or a biologically active variant that shares substantial identity with SEQ ID NO: 55. In some embodiments, the variant has at least 70%, or at least 75%, 80%, or 85% identity to SEQ ID NO: 55. In some embodiments, the variant has at least 90%, or at least 91%, 92%, 93%, or 94% identity to the amino acid sequence of SEQ ID NO: 55. In some embodiments, the variant has at least 95% identity to SEQ ID NO: 55. As used herein, the term "variant" encompasses biologically active polypeptides having one or more substitutions, deletions, or insertions relative to SEQ ID NO: 55. Thus, the term "variant" includes biologically active fragments as well as substitution variants.

In some embodiments, a yeast host cell is genetically modified in accordance with the invention to express an ABC transporter polypeptide having the amino acid sequence of any one of SEQ ID NOS: 99-126, or a biologically active variant that shares substantial identity with any one of SEQ ID NOS: 99-126. In some embodiments, the variant has at least 70%, or at least 75%, 80%, or 85% identity to any one of SEQ ID NOS: 99-126. In some embodiments, the variant has at least 90%, or at least 91%, 92%, 93%, or 94% identity to the amino acid sequence of any one of SEQ ID NOS: 99-126. In some embodiments, the variant has at least 95% identity to of any one of SEQ ID NOS: 99-126. As used herein, the term "variant" encompasses biologically active polypeptides having one or more substitutions, deletions, or insertions relative to any one of SEQ ID NOS: 99-126. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 99, or a biologically active variant that shares substantial identity with SEQ ID NO: 99. In some embodiments, the variant has at least 70%, or at least 75%, 80%, or 85% identity to SEQ ID NO: 99. In some embodiments, the variant has at least 90%, or at least 91%, 92%, 93%, or 94% identity to the amino acid sequence of SEQ ID NO: 99. In some embodiments, the variant has at least 95% identity to SEQ ID NO: 99. As used herein, the term "variant" encompasses biologically active polypeptides having one or more substitutions, deletions, or insertions relative to SEQ ID NO: 99. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 100, or a biologically active variant that shares substantial identity with SEQ ID NO: 100. In some embodiments, the variant has at least 70%, or at least 75%, 80%, or 85% identity to SEQ ID NO: 100. In some embodiments, the variant has at least 90%, or at least 91%, 92%, 93%, or 94% identity to the amino acid sequence of SEQ ID NO: 100. In some embodiments, the variant has at least 95% identity to SEQ ID NO: 100. As used herein, the term "variant" encompasses biologically active polypeptides having one or more substitutions, deletions, or insertions relative to SEQ ID NO: 100. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 101, or a biologically active variant that shares substantial identity with SEQ ID NO: 101. In some embodiments, the variant has at least 70%, or at least 75%, 80%, or 85% identity to SEQ ID NO: 101. In some embodiments, the variant has at least 90%, or at least 91%, 92%, 93%, or 94% identity to the amino acid sequence of SEQ ID NO: 101. In some embodiments, the variant has at least 95% identity to SEQ ID NO: 101. As used herein, the term "variant" encompasses biologically active polypeptides having one or more substitutions, deletions, or insertions relative to SEQ ID NO: 101. Thus, the term "variant" includes biologically active fragments as well as substitution variants.

In some embodiments, a yeast host cell is genetically modified in accordance with the invention to express an ABC transporter polypeptide having the amino acid sequence of SEQ ID NO: 102, or a biologically active variant that shares substantial identity with SEQ ID NO: 102. In some embodiments, the variant has at least 70%, or at least 75%, 80%, or 85% identity to SEQ ID NO: 102. In some embodiments, the variant has at least 90%, or at least 91%, 92%, 93%, or 94% identity to the amino acid sequence of SEQ ID NO: 102. In some embodiments, the variant has at least 95% identity to SEQ ID NO: 102. As used herein, the term "variant" encompasses biologically active polypeptides having one or more substitutions, deletions, or insertions relative to SEQ ID NO: 102. Thus, the term "variant" includes biologically active fragments as well as substitution variants.

ABC transporter activity can be assessed using any number of assays, including assays that evaluate the overall production of at least one HMO by a yeast cell strain. For example, production yields are calculated by quantifying sugar input into fermentation tanks and measuring residual sucrose levels and constituent glucose and fructose monomers, via comparison to known standard concentrations and analysis through ion exchange chromatography. Thus, for example, yield of 2'-FL is therefore assessed by comparing 2'-FL output to sucrose input. In some embodiments, the production yield of 2'-fucosyllactose by a genetically modified yeast strain is measured by quantifying total sucrose fed and total 2'-fucosyllactose produced using ion exchange chromatography (IC). Yield is reported as g 2'-fucosyllactose/g sucrose. Any other method that allows one of skill to assess ABC transporter activity may also be employed.

In some embodiments, an ABC transport polypeptide increases HMO production, e.g., 2'-fucosylactose production, by at least 10%, at least 20%, at least 30%, at least 40%, at least 45%, at least 50%, or greater, when expressed in a host cell compared to a counterpart host cell of the same strain that comprises the same genetic modifications other than the modification to express the heterologous ABC transporter polypeptide. In some embodiments, expression of a polypeptide having the amino acid sequence of SEQ ID NO: 1, 2, or 3, or variant thereof having at least 70%, 75%, 80%, 85%, 90%, or at least 95% identity to SEQ ID NO: 1, 2, or 3, increases HMO production, e.g., 2'-fucosyllactose production, by at least 10%, at least 20%, at least 30%, at least 40%, at least 45%, at least 50% or greater, when expressed in a host cell that is modified to express one or more HMOs. In some embodiments, expression of a polypeptide having the amino acid sequence of any one of SEQ ID NOS: 4-27, or variant thereof having at least 70%, 75%, 80%, 85%, 90%, or at least 95% identity to any one of SEQ ID NOS:4-27, increases HMO production, e.g., 2'-fucosyllactose production, by at least 10%, at least 20%, at least 30%, at least 40%, at least 45%, at least 50% or greater, when expressed in a host cell that is modified to express one or more HMOs.

Yeast Genetically Modified to Produce HMO

Provided herein are genetically modified yeast cells capable of producing one or more HMOs, which yeast cells are further modified to express a heterologous ABC transport polypeptide, e.g., SEQ ID NO: 1, 2, or 3, or a biologically active variant thereof; or to express a heterologous ABC transport polypeptide, e.g., any one of SEQ ID NOS: 4-27, or a biologically active variant thereof. Such yeast cells include one or more heterologous nucleic acids, each independently encoding an enzyme of a HMO biosynthetic pathway; and a heterologous nucleic acid encoding an export protein, e.g., an ABC transporter such as a polypeptide comprising the amino acid of any one of SEQ ID NOS: 1, 2, and 3; and any one of SEQ ID NOS: 4-27; or a variant thereof, that mediates export of an HMO. In some embodiments, the biosynthetic pathways of the provided yeast cells generate GDP-fucose from an external sugar such as glucose or sucrose, and not from external fucose. In further embodiments, a genetically modified yeast cells of the present disclosure comprises a heterologous nucleic acid encoding a fucokinase, an enzyme used in an alternate pathway converting fucose to GDP-fucose.

In some embodiments, the provided genetically modified yeast cells are capable of producing the UDP-glucose HMO precursor. The activated sugar UDP-glucose is composed of a pyrophosphate group, the pentose sugar ribose, glucose, and the nucleobase uracil. UDP-glucose is natively produced by yeast cells, and its production levels can be increased with overexpression of, for example, phosphoglucomutase-2 (PGM2) or UTP glucose-1-phosphate uridylyltransferase (UGP1).

In some embodiment, the provided genetically modified yeast cells are capable of producing the UDP-galactose HMO precursor. The activated sugar UDP-galactose is composed of a pyrophosphate group, the pentose sugar ribose, galactose, and the nucleobase uracil. UDP-galactose is natively produced by yeast cells, and its production levels can be increased with overexpression of, for example, UDP-glucose-4-epimerase (GAL10).

In some embodiments, the provided genetically modified yeast cells are capable of producing the UDP-N-acetylglucosamine HMO precursor. The activated sugar UDP-N-acetylglucosamine consists of a pyrophosphate group, the pentose sugar ribose, N-acetylglucosamine, and the nucleobase uracil. UDP-N-acetylglucosamine is natively produced by yeast cells, and its production levels can be increased with expression of, for example, UDP-N-acetylglucosamine-diphosphorylase, or overexpression of, for example, glucosamine 6-phosphate N-acetyltransferase (GNA1) or phosphoacetylglucosamine mutase (PCM1).

In some embodiments, the provided genetically modified yeast cells are capable of producing the GDP-fucose HMO precursor. The activated sugar GDP-fucose consists of a pyrophosphate group, the pentose sugar ribose, fucose, and the nucleobase guanine. GDP-fucose is not natively produced by yeast cells, and its production can be enabled with the introduction of, for example, GDP-mannose 4,6-dehydratase, e.g., from *Escherichia coli*, and GDP-L-fucose synthase, e.g., from *Arabidopsis thaliana*.

In some embodiments, the provided genetically modified yeast cells are capable of producing the CMP-sialic acid HMO precursor. The activated sugar CMP-sialic acid consists of a pyrophosphate group, the pentose sugar ribose, sialic acid, and the nucleobase cytosine. CMP-sialic acid is not natively produced by yeast cells, and its production can be enabled with the introduction of, for example, CMP-Neu5Ac synthetase, e.g., from *Campylobacter jejuni*, sialic acid synthase, e.g., from *C. jejuni*, and UDP-N-acetylglucosamine 2-epimerase, e.g., from *C. jejuni*.

In some embodiments, the genetically modified yeast is capable of producing 2'-fucosyllactose. In addition to one or more heterologous nucleic acids encoding one or more of the aforementioned enzymes, the yeast can further include one or more heterologous nucleic acids encoding one or more of GDP-mannose 4,6-dehydratase, e.g., from *Escherichia coli*, GDP-L-fucose synthase, e.g., from *Arabidopsis thaliana*, α-1,2-fucosyltransferase, e.g., from *Helicobacter pylori*, and a fucosidase, e.g., an α-1,3-fucosidase. In some embodiments, the fucosyltransferase is from *Candidata moranbacterium* or *Pseudoalteromonas haloplanktis*.

In some embodiments, the genetically modified yeast cell includes a heterologous nucleic acid encoding an enzyme that can catalyze the conversion of GDP-mannose to GDP-4-dehydro-6-deoxy-D-mannose, e.g., a GDP-mannose 4,6-dehydratase. In some embodiments, the GDP-mannose 4,6-dehydratase is from *Escherichia coli*. Other suitable GDP-mannose 4,6-dehydratase sources include, for example and without limitation, *Caenorhabditis elegans, Homo sapiens, Arabidopsis thaliana, Dictyostelium discoideum, Mus musculus, Drosophila melanogaster, Sinorhizobium fredii* HH103, *Sinorhizobium fredii* NGR234, Planctomycetes bacterium RBG_13_63_9, *Silicibacter* sp. TrichCH4B, *Pandoraea vervacti, Bradyrhizobium* sp. YR681, *Epulopiscium* sp. SCG-B11WGA-EpuloA1, *Caenorhabditis briggsae*, Candidatus Curtissbacteria bacterium RIFCSPLOWO2_12_FULL_38_9, *Pseudomonas* sp. EpS/L25, *Clostridium* sp. KLE 1755, mine drainage metagenome, *Nitrospira* sp. SG-bin2, *Cricetulus griseus, Arthrobacter siccitolerans*, and *Paraburkholderia piptadeniae*. In some embodiments, the GDP-mannose dehydratase is from *Caenorhabditis briggsae* or *Escherichia coli*.

In some embodiments, the genetically modified yeast cell includes a heterologous nucleic acid encoding an enzyme that can catalyze the conversion of GDP-4-dehydro-6-deoxy-D-mannose to GDP-L-fucose, e.g., a GDP-L-fucose synthase. In some embodiments, the GDP-L-fucose synthase is from *Arabidopsis thaliana*. Other suitable GDP-L-fucose synthase sources include, for example and without limitation, *Mus musculus, Escherichia coli* K-12, *Homo sapiens, Marinobacter salarius, Sinorhizobiumfredii* NGR234, *Oryza sativa Japonica* Group, *Micavibrio aeruginosavorus* ARL-13, *Citrobacter* sp. 86, *Pongo abelii, Caenorhabditis elegans*, Candidatus *Staskawiczbacteria bacterium* RIFCSPHIGH02_01_FULL_41_41, *Drosophila melanogaster, Azorhizobium caulinodans* ORS 571, Candidatus *Nitrospira nitrificans, Mycobacterium elephantis, Elusimicrobia bacterium* RBG_16_66_12, *Vibrio* sp. JCM 19231, *Planktothrix serta* PCC 8927, *Thermodesulfovibrio* sp. RBG_19FT_COMBO_42_12, *Anaerovibrio* sp. JC8, *Dictyostelium discoideum*, and *Cricetulus griseus*.

In some embodiments, the genetically modified yeast cell includes a heterologous nucleic acid encoding an enzyme that can catalyze the conversion of GDP-L-fucose and lactose to 2'-fucosyllactose, e.g., an α-1,2-fucosyltransferase. In some embodiments, the α-1,2-fucosyltransferase is from *Helicobacter pylori*. In some embodiments, the fucosyltransferase is from *Candidata moranbacterium* or *Pseudoalteromonas haloplanktis* ANT/505. Other suitable α-1,2-fucosyltransferase sources include, for example and without limitation, *Escherichia coli, Sus scrofa, Homo sapiens, Chlorocebus sabaeus, Pan troglodytes, Gorilla gorilla gorilla, Macaca mulatta, Oryctolagus cuniculus, Pongo pygmaeus, Mus musculus, Rattus norvegicus, Caenorhabditis elegans, Hylobates lar, Bos taurus, Hylobates agilis, Eulemur fulvus*, and *Helicobacter hepaticus* ATCC 51449. In some embodiments, the source of the α-1,2-fucosyltransferase is *Pseudoalteromonas haloplanktis* ANT/505, *Candidatus moranbacteria bacterium, Acetobacter* sp. CAG: 267, *Bacteroides vulgatus, Sulfurovum lithotrophicum, Thermosynechococcus elongatus* BP-1, *Geobacter uraniireducens* Rf4, *Bacteroides fragilis* str. S23L17, *Chromobacterium vaccinii, Herbaspirillum* sp. YR522, or *Helicobacter bilis* ATCC 43879.

In some embodiments, the genetically modified yeast cell includes a heterologous nucleic acid encoding an enzyme that can catalyze the conversion of difucosyllactose to 2'-fucosyllactose and fucose, e.g., an α1-3,4-fucosidase. Suitable α1-3,4-fucosidase sources include, for example and without limitations, *Bacteroides thetaiotaomicron, Bifidobacterium bifidum, Bifidobacterium longum, Bifidobacterium longum* subsp. *infantis, Clostridium perfringens, Lactobacillus casei, Paenibacillus thiaminolyticus, Pseudomonas putida, Thermotoga maritima, Xanthomonas campestris* pv. *campestris, Arabidopsis thaliana*, and *Rattus norvegicus*.

In some embodiments, the genetically modified yeast is capable of producing 3-fucosyllactose. In addition to one or more heterologous nucleic acids encoding one or more of the aforementioned enzymes, the yeast can further include one or more heterologous nucleic acids encoding one or more of GDP-mannose 4,6-dehydratase, e.g., from *Escherichia coli*, GDP-L-fucose synthase, e.g., from *Arabidopsis thaliana*, a-1,3-fucosyltransferase, e.g., from *Helicobacter pylori*, and a fucosidase, e.g., an α-1,2-fucosidase.

In some embodiments, the genetically modified yeast cell includes a heterologous nucleic acid encoding an enzyme that can catalyze the conversion of GDP-L-fucose and lactose to 3-fucosyllactose, e.g., an α-1,3-fucosyltransferase. In some embodiments, the α-1,3-fucosyltransferase is from *Helicobacter pylori*. Other suitable α-1,3-fucosyltransferase sources include, for example and without limitation, *Homo sapiens, Escherichia coli, Sus scrofa, Chlorocebus sabaeus, Pan troglodytes, Gorilla gorilla gorilla, Macaca mulatta, Oryctolagus cuniculus, Pongo pygmaeus, Mus musculus, Rattus norvegicus, Caenorhabditis elegans, Hylobates lar, Bos taurus, Hylobates agilis, Eulemur fulvus, Helicobacter hepaticus* ATCC 51449, *Akkermansia muciniphila, Bacteroides fragilis*, and *Zea mays*.

In some embodiments, the genetically modified yeast is capable of producing lacto-N-tetraose. In addition to one or more heterologous nucleic acids encoding one or more of the aforementioned enzymes, the yeast can further include one or more heterologous nucleic acids encoding one or more of β-1,3-N-acetylglucosaminyltransferase, e.g., from *Neisseria meningitidis*, β-1,3-galactosyltransferase, e.g., from *Escherichia coli*, and UDP-N-acetylglucosamine-diphosphorylase, e.g., from *E. coli*.

In some embodiments, the genetically modified yeast cell includes a heterologous nucleic acid encoding an enzyme that can catalyze the conversion of UDP-N-acetyl-alpha-D-glucosamine and lactose to lacto-N-triose II and UDP, e.g., a β-1,3-N-acetylglucosaminyltransferase. In some embodiments, the β-1,3-N-acetylglucosaminyltransferase is from *Neisseria meningitidis*. Other suitable β-1,3-N-acetylglucosaminyltransferase sources include, for example and without limitation, *Arabidopsis thaliana, Streptococcus dysgalactiae* subsp. *equisimilis, Escherichia coli*, e.g., *Escherichia coli* K-12, *Pseudomonas aeruginosa* PAO1, *Homo sapiens, Mus musculus, Mycobacterium smegmatis* str. MC2 155, *Dictyostelium discoideum, Komagataeibacter hansenii, Aspergillus nidulans* FGSC A4, *Schizosaccharomyces pombe* 972h-, *Neurospora crassa* OR74A, *Aspergillus fumigatus* Af293, *Ustilago maydis* 521, *Bacillus subtilis* subsp. *subtilis* str. 168, *Rattus norvegicus, Listeria monocytogenes* EGD-e, *Bradyrhizobium japonicum, Nostoc* sp. PCC 7120, *Haloferax volcanii* DS2, *Caulobacter crescentus* CB 15, *Mycobacterium avium* subsp. *silvaticum, Oenococcus oeni, Neisseria gonorrhoeae, Propionibacterium freudenreichii* subsp. *shermanii, Escherichia coli* 0157:1H7, *Aggregatibacter actinomycetemcomitans, Bradyrhizobium diazoefficiens* USDA 110, *Francisella tularensis* subsp. *novicida* U112, *Komagataeibacter xylinus, Haemophilus influenzae* Rd KW20, *Fusobacterium nucleatum* subsp. *nucleatum* ATCC 25586, *Bacillus* phage SPbeta, *Coccidioides posadasii, Populus tremula*x*Populus alba, Rhizopus microsporus* var. *oligosporus, Streptococcus parasanguinis, Shigella flexneri, Caenorhabditis elegans, Hordeum vulgare, Synechocystis* sp. PCC 6803 substr. *Kazusa, Streptococcus agalactiae, Plasmopara viticola, Staphylococcus epidermidis* RP62A, *Shigella* phage SfII, Plasmid pWQ799, *Fusarium graminearum, Sinorhizobium meliloti* 1021, *Physcomitrella patens, Sphingomonas* sp. S88, *Streptomyces hygroscopicus* subsp. *jinggangensis* 5008, *Drosophila melanogaster, Phytophthora infestans, Staphylococcus aureus* subsp. *aureus* Mu50, *Penicillium chrysogenum*, and *Tribolium castaneum*.

In some embodiments, the genetically modified yeast cell includes a heterologous nucleic acid encoding an enzyme that can catalyze the conversion of UDP-galactose and lacto-N-triose II to lacto-N-tetraose and UDP, e.g., a β-1,3-galactosyltransferase. In some embodiments, the β-1,3-galactosyltransferase is from *Escherichia coli*. Other suitable β-1,3-galactosyltransferase sources include, for example and without limitation, *Arabidopsis thaliana, Streptococcus dysgalactiae* subsp. *equisimilis, Pseudomonas aeruginosa* PAO1, *Homo sapiens, Mus musculus, Mycobacterium smegmatis* str. MC2 155, *Dictyostelium discoideum, Komagataeibacter hansenii, Aspergillus nidulans* FGSC A4, *Schizosaccharomyces pombe* 972h-, *Neurospora crassa* OR74A, *Aspergillus fumigatus* Af293, *Ustilago maydis* 521, *Bacillus subtilis* subsp. *subtilis* str. 168, *Rattus norvegicus, Neisseria meningitidis, Listeria monocytogenes* EGD-e, *Bradyrhizobium japonicum, Nostoc* sp. PCC 7120, *Haloferax volcanii* DS2, *Caulobacter crescentus* CB15, *Mycobacterium avium* subsp. *silvaticum, Oenococcus oeni, Neisseria gonorrhoeae, Propionibacterium freudenreichii* subsp. *shermanii, Aggregatibacter actinomycetemcomitans, Bradyrhizobium diazoefficiens* USDA 110, *Francisella tularensis* subsp. *novicida* U112, *Komagataeibacter xylinus, Haemophilus influenzae* Rd KW20, *Fusobacterium nucleatum* subsp. *nucleatum* ATCC 25586, *Bacillus* phage SPbeta, *Coccidioides posadasii, Populus tremula*x*Populus alba, Rhizopus microsporus* var. *oligosporus, Streptococcus parasanguinis, Shigella flexneri, Caenorhabditis elegans, Hordeum vulgare, Synechocystis* sp. PCC 6803 substr. *Kazusa, Streptococcus agalactiae, Plasmopara viticola, Staphylococcus epidermidis* RP62A, *Shigella* phage SfII, Plasmid pWQ799, *Fusarium graminearum, Sinorhizobium meliloti* 1021, *Physcomitrella patens, Sphingomonas* sp. S88, *Streptomyces hygroscopicus* subsp. *jinggangensis* 5008, *Drosophila mela-* nogaster, Phytophthora infestans, Staphylococcus aureus subsp. aureus Mu50, Penicillium chrysogenum, and Tribolium castaneum.

In some embodiments, the genetically modified yeast cell includes a heterologous nucleic acid encoding an enzyme that can catalyze the conversion of N-acetyl-α-D-glucosamine 1-phosphate to UDP-N-acetyl-α-D-glucosamine, e.g., a UDP-N-acetylglucosamine-diphosphorylase. In some embodiments, the UDP-N-acetylglucosamine-diphosphorylase is from Escherichia coli.

In some embodiments, the genetically modified yeast is capable of producing lacto-N-neotetraose. In addition to one or more heterologous nucleic acids encoding one or more of the aforementioned enzymes, the yeast can further include one or more heterologous nucleic acids encoding one or more of β-1,3-N-acetylglucosaminyltransferase, e.g., from Neisseria meningitidis, β-1,4-galactosyltransferase, e.g., from N. meningitidis, and UDP-N-acetylglucosamine-diphosphorylase, e.g., from E. coli.

In some embodiments, the genetically modified yeast cell includes a heterologous nucleic acid encoding an enzyme that can catalyze the conversion of UDP-galactose and lacto-N-triose II to lacto N-neotetraose and UDP, e.g., a β-1,4-galactosyltransferase. In some embodiments, the β-1,4-galactosyltransferase is from Neisseria meningitidis. Other suitable β-1,4-galactosyltransferase sources include, for example and without limitation, Homo sapiens, Neisseria gonorrhoeae, Haemophilus influenzae, Acanthamoeba polyphaga mimivirus, Haemophilus influenzae Rd KW20, Haemophilus ducreyi 35000HP, Moraxella catarrhalis, [Haemophilus] ducreyi, Aeromonas salmonicida subsp. salmonicida A449, and Helicobacter pylori 26695.

In some embodiments, the genetically modified yeast is capable of producing 3'-sialyllactose. In addition to heterologous nucleic acids encoding one or more of the aforementioned enzymes, the yeast can further include heterologous nucleic acids encoding CMP-Neu5Ac synthetase, e.g., from Campylobacter jejuni, sialic acid synthase, e.g., from C. jejuni, UDP-N-acetylglucosamine 2-epimerase, e.g., from C. jejuni, UDP-N-acetylglucosamine-diphosphorylase, e.g., from E. coli, and CMP-N-acetylneuraminate-β-galactosamide-α-2,3-sialyltransferase, e.g., from N. meningitides MC58.

In some embodiments, the genetically modified yeast cell includes a heterologous nucleic acid encoding an enzyme that can catalyze the conversion of UDP-N-acetyl-α-D-glucosamine to N-acetyl-mannosamine and UDP, e.g., a UDP-N-acetylglucosamine 2-epimerase. In some embodiments, the UDP-N-acetylglucosamine 2-epimerase is from Campylobacter jejuni. Other suitable UDP-N-acetylglucosamine 2-epimerase sources include, for example and without limitation, Homo sapiens, Rattus norvegicus, Mus musculus, Dictyostelium discoideum, Plesiomonas shigelloides, Bacillus subtilis subsp. subtilis str. 168, Bacteroides fragilis, Geobacillus kaustophilus HTA426, Synechococcus sp. CC9311, Sphingopyxis alaskensis RB2256, Synechococcus sp. RS9916, Moorella thermoacetica ATCC 39073, Psychrobacter sp. 1501(2011), Zunongwangia profunda SM-A87, Thiomicrospira crunogena XCL-2, Polaribacter sp. MED152, Vibrio campbellii ATCC BAA-1116, Thiomonas arsenitoxydans, Nitrobacter winogradskyi Nb-255, Raphidiopsis brookii D9, Thermoanaerobacter italicus Ab9, Roseobacter litoralis Och 149, Halothiobacillus neapolitanus c2, Halothiobacillus neapolitanus c2, Bacteroides vulgatus ATCC 8482, Zunongwangia profunda SM-A87, Moorella thermoacetica ATCC 39073, Paenibacillus polymyxa E681, Desulfatibacillum alkenivorans AK-01, Magnetospirillum magneticum AMB-1, Thermoanaerobacter italicus Ab9, Paenibacillus polymyxa E681, Prochlorococcus marinus str. MIT 9211, Subdoligranulum variabile DSM 15176, Kordia algicida OT-1, Bizionia argentinensis JUB59, Tannerella forsythia 92A2, Thiomonas arsenitoxydans, Synechococcus sp. BL107, Escherichia coli, Vibrio campbellii ATCC BAA-1116, Rhodopseudomonas palustris HaA2, Roseobacter litoralis Och 149, Synechococcus sp. CC9311, Subdoligranulum variabile DSM 15176, Bizionia argentinensis JUB59, Selenomonas sp. oral taxon 149 str. 67H29BP, Bacteroides vulgatus ATCC 8482, Kordia algicida OT-1, Desulfatibacillum alkenivorans AK-01, Thermodesulfovibrio yellowstonii DSM 11347, Desulfovibrio aespoeensis Aspo-2, Synechococcus sp. BL107, and Desulfovibrio aespoeensis Aspo-2.

In some embodiments, the genetically modified yeast cell includes a heterologous nucleic acid encoding an enzyme that can catalyze the conversion of N-acetyl-mannosamine and phosphoenolpyruvate to N-acetylneuraminate, e.g., a sialic acid synthase. In some embodiments, the sialic acid synthase is from Campylobacter jejuni. Other suitable sialic acid synthase sources include, for example and without limitation, Homo sapiens, groundwater metagenome, Prochlorococcus marinus str. MIT 9211, Rhodospirillum centenum SW, Rhodobacter capsulatus SB 1003, Aminomonas paucivorans DSM 12260, Ictalurus punctatus, Octadecabacter antarcticus 307, Octadecabacter arcticus 238, Butyrivibrio proteoclasticus B316, Neisseria meningitidis serogroup B., Idiomarina loihiensis L2TR, Butyrivibrio proteoclasticus B316, and Campylobacter jejuni.

In some embodiments, the genetically modified yeast cell includes a heterologous nucleic acid encoding an enzyme that can catalyze the conversion of N-acetylneuraminate and CTP to CMP-N-acetylneuraminate, e.g., a CMP-Neu5Ac synthetase. In some embodiments, the CMP-Neu5Ac synthetase is from Campylobacter jejuni. Other suitable CMP-Neu5Ac synthetase sources include, for example and without limitation, Neisseria meningitidis, Streptococcus agalactiae NEM316, Homo sapiens, Mus musculus, Bacteroides thetaiotaomicron, Pongo abelii, Danio rerio, Oncorhynchus mykiss, Bos taurus, Drosophila melanogaster, and Streptococcus suis BM407.

In some embodiments, the genetically modified yeast cell includes a heterologous nucleic acid encoding an enzyme that can catalyze the conversion of CMP-N-acetylneuraminate and lactose to 3'-siallyllactose and CMP, e.g., a CMP-N-acetylneuraminate-β-galactosamide-α-2,3-sialyltransferase. In some embodiments, the CMP-N-acetylneuraminate-β-galactosamide-α-2,3-sialyltransferase is from N. meningitides MC58. Other suitable CMP-N-acetylneuraminate-β-galactosamide-α-2,3-sialyltransferase sources include, for example and without limitation, Homo sapiens, Neisseria meningitidis alpha14, Pasteurella multocida subsp. multocida str. Pm70, Pasteurella multocida, and Rattus norvegicus.

In some embodiments, the genetically modified yeast cell is capable of producing 6'-sialyllactose. In addition to one or more heterologous nucleic acids encoding one or more of the aforementioned enzymes, the yeast can further include one or more heterologous nucleic acids encoding one or more of CMP-Neu5Ac synthetase, e.g., from Campylobacter jejuni, sialic acid synthase, e.g., from C. jejuni, UDP-N-acetylglucosamine 2-epimerase, e.g., from C. jejuni, UDP-N-acetylglucosamine-diphosphorylase, e.g., from E. coli, and β-galactoside α-2,6-sialyltransferase, e.g., from Photobacterium sp. JT-ISH-224.

In some embodiments, the genetically modified yeast cell includes a heterologous nucleic acid encoding an enzyme that can catalyze the conversion of CMP-N-acetylneuraminate and lactose to 3'-sialyllactose and CMP, e.g., a β-galactoside-α-2,6-sialyltransferase. In some embodiments, the β-galactoside-α-2,6-sialyltransferase is from Photobacterium sp. JT-ISH-224. Other suitable β-galactoside-α-2,6-sialyltransferase sources include, for example and without limitation, *Homo sapiens, Photobacterium damselae, Photobacterium leiognathi*, and *Photobacterium phosphoreum* ANT-2200.

In some embodiments, the genetically modified yeast cell is *Saccharomyces cerevisae. Saccharomyces cerevisae* strains suitable for genetic modification and cultivation to produce HMOs as disclosed herein include, but are not limited to, Baker's yeast, CBS 7959, CBS 7960, CBS 7961, CBS 7962, CBS 7963, CBS 7964, IZ-1904, TA, BG-1, CR-1, SA-1, M-26, Y-904, PE-2, PE-5, VR-1, BR-1, BR-2, ME-2, VR-2, MA-3, MA-4, CAT-1, CB-1, NR-1, BT-1, CEN.PK, CEN.PK2, and AL-1. In some embodiments, the host cell is a strain of *Saccharomyces cerevisiae* selected from the group consisting of PE-2, CAT-1, VR-1, BG-1, CR-1, and SA-1. In certain aspects, the strain of *Saccharomyces cerevisiae* is PE-2. In certain embodiments, the strain of *Saccharomyces cerevisiae* is CAT-1. In some aspects, the strain of *Saccharomyces cerevisiae* is BG-1.

In some embodiments, the genetically modified yeast cell is *Saccharomyces cerevisiae*, and in addition to heterologous nucleic acids encoding one or more of the aforementioned enzymes, the yeast can further include a heterologous nucleic acid encoding a lactose transporter. In some embodiments, the lactose transporter is a lactose permease, e.g., LAC12 from *Kluyveromyces lactis*. In some embodiments, the lactose permease is from *Neurospora crassa*, e.g., Cdt2. In some embodiments, the lactose permease is from *Neofusicoccum parvum*, e.g., *Neofusicoccum parvum* UCRNP2 (1287680). Other suitable lactose permease sources include, for example and without limitation, *Scheffersomyces stipitis, Aspergillus lentulus, Emericella nidulans, Dacryopinax primogenitus, Microdochium bolleyi, Beauveria bassiana, Metarhizium robertsii, Phialocephala, Botryosphaeria parva, Moniliophthora roreri, Cordyceps fumosorosea, Diplodia seriata, Hypocrea jecorina*, and *Kluyveromyces marxianus*.

In some embodiments, the genetically modified yeast cell is *Kluyveromyces marxianus. Kluyveromyces marxianus* can present several advantages for industrial production, including high temperature tolerance, acid tolerance, native uptake of lactose, and rapid growth rate. Beneficially, this yeast is genetically similar enough to *Saccharomyces cerevisiae* that similar or identical promoters and codon optimized genes can be used among the two yeast species. Furthermore, because *Kluyveromyces marxianus* has a native lactose permease, it is not necessary to introduce a heterologous nucleic acid to introduce this functionality. In some embodiments, at least a portion of the β-galactosidase gene (LAC4) required for metabolizing lactose is deleted in the genetically modified yeast. Thus, the modified *Kluyveromyces marxianus* strain is capable of importing lactose without consuming it. In some embodiments, the expression of the β-galactosidase gene in the genetically modified yeast is decreased relative to the expression in wild-type *Kluyveromyces marxianus*. Thus, the modified *Kluyveromyces marxianus* strain has reduced consumption of imported lactose.

In some embodiments, the genetically modified yeast cell includes a promoter that regulates the expression and/or stability of at least one of the one or more heterologous nucleic acids. In certain aspects, the promoter negatively regulates the expression and/or stability of the at least one heterologous nucleic acid. The promoter can be responsive to a small molecule that can be present in the culture medium of a fermentation of the modified yeast. In some embodiments, the small molecule is maltose or an analog or derivative thereof. In some embodiments, the small molecule is lysine or an analog or derivative thereof. Maltose and lysine can be attractive selections for the small molecule as they are relatively inexpensive, non-toxic, and stable.

In some embodiments, the promoter that regulates expression of the ABC transporter polypeptide, e.g., the polypeptide of SEQ ID NO: 1, 2, or 3, or a variant thereof as described herein, is a relatively weak promoter, or an inducible promoter. Illustrative promoters include, for example, lower-strength GAL pathway promoters, such as GAL10, GAL2, and GAL3 promoters. Additional illustrative promoters for expressing an ABC transporter polypeptide include constitutive promoters from *S. cerevisiae* native promoters, such as the promoter from the native TDH3 gene. In some embodiments, a lower strength promoter provides a decrease in expression of at least 25%, or at least 30%, 40%, or 50%, or greater, when compared to a GAL1 promoter.

Expression of an ABC transporter polypeptide, e.g., the polypeptide of SEQ ID NO: 1, 2, or 3, or a variant thereof as described herein can be accomplished by introducing into the host cells a nucleic acid comprising a nucleotide sequence encoding the ABC transporter polypeptide under the control of regulatory elements that permit expression in the host cell. In some embodiments, the nucleic acid is an extrachromosomal plasmid. In other embodiments, the nucleic acid is a chromosomal integration vector that can integrate the nucleotide sequence into the chromosome of the host cell. Expression of a polypeptide of any one of SEQ ID NOS: 4-27, or a variant thereof as described herein can be achieved by using parallel methodology.

In some embodiments, the one or more heterologous nucleic acids are introduced into the genetically modified yeast cells by using a gap repair molecular biology technique. In these methods, if the yeast has non-homologous end joining (NHEJ) activity, as is the case for *Kluyveromyces marxianus*, then the NHEJ activity in the yeast can be first disrupted in any of a number of ways. Further details related to genetic modification of yeast cells through gap repair can be found in U.S. Pat. No. 9,476,065, the full disclosure of which is incorporated by reference herein in its entirety for all purposes.

In some embodiments, the one or more heterologous nucleic acids are introduced into the genetically modified yeast cells by using one or more site-specific nucleases capable of causing breaks at designated regions within selected nucleic acid target sites. Examples of such nucleases include, but are not limited to, endonucleases, site-specific recombinases, transposases, topoisomerases, zinc finger nucleases, TAL-effector DNA binding domain-nuclease fusion proteins (TALENs), CRISPR/Cas-associated RNA-guided endonucleases, and meganucleases. Further details related to genetic modification of yeast cells through site specific nuclease activity can be found in U.S. Pat. No. 9,476,065, the full disclosure of which is incorporated by reference herein in its entirety for all purposes.

Described herein are specific genes and proteins useful in the methods, compositions, and organisms of the disclosure; however, it will be recognized that absolute identity to such genes is not necessary. For example, changes in a particular gene or polynucleotide comprising a sequence encoding a polypeptide or enzyme can be performed and screened for activity. Typically, such changes comprise conservative mutations and silent mutations. Such modified or mutated polynucleotides and polypeptides can be screened for expression of a functional enzyme using methods known in the art. Due to the inherent degeneracy of the genetic code, other polynucleotides which encode substantially the same or functionally equivalent polypeptides can also be used to clone and express the polynucleotides encoding such enzymes.

As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons. Codons can be substituted to reflect the preferred codon usage of the host, in a process sometimes called "codon optimization" or "controlling for species codon bias."

Optimized coding sequences containing codons preferred by a particular prokaryotic or eukaryotic host (Murray et al., 1989, Nucl Acids Res. 17: 477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, typical stop codons for *S. cerevisiae* and mammals are UAA and UGA, respectively. The typical stop codon for monocotyledonous plants is UGA, whereas insects and *E. coli* commonly use UAA as the stop codon (Dalphin et al., 1996, Nucl Acids Res. 24: 216-8).

Those of skill in the art will recognize that, due to the degenerate nature of the genetic code, a variety of DNA molecules differing in their nucleotide sequences can be used to encode a given heterologous polypeptide of the disclosure. A native DNA sequence encoding the biosynthetic enzymes described above is referenced herein merely to illustrate an embodiment of the disclosure, and the disclosure includes DNA molecules of any sequence that encode the amino acid sequences of the polypeptides and proteins of the enzymes utilized in the methods of the disclosure. In similar fashion, a polypeptide can typically tolerate one or more amino acid substitutions, deletions, and insertions in its amino acid sequence without loss or significant loss of a desired activity. The disclosure includes such polypeptides with different amino acid sequences than the specific proteins described herein so long as the modified or variant polypeptides have the enzymatic anabolic or catabolic activity of the reference polypeptide. Furthermore, the amino acid sequences encoded by the DNA sequences shown herein merely illustrate embodiments of the disclosure.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties, e.g., charge or hydrophobicity. In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art (See, e.g., Pearson W. R., 1994, Methods in Mol. Biol. 25: 365-89).

Furthermore, any of the genes encoding the foregoing enzymes (or any others mentioned herein (or any of the regulatory elements that control or modulate expression thereof) can be optimized by genetic/protein engineering techniques, such as directed evolution or rational mutagenesis, which are known to those of ordinary skill in the art. Such action allows those of ordinary skill in the art to optimize the enzymes for expression and activity in yeast.

In addition, genes encoding these enzymes can be identified from other fungal and bacterial species and can be expressed for the modulation of this pathway. A variety of organisms could serve as sources for these enzymes, including, but not limited to, *Saccharomyces* spp., including *S. cerevisiae* and *S. uvarum*, *Kluyveromyces* spp., including *K. thermotolerans*, *K. lactis*, and *K. marxianus*, *Pichia* spp., *Hansenula* spp., including *H. polymorpha*, *Candida* spp., *Trichosporon* spp., *Yamadazyma* spp., including *Y.* spp. *stipitis*, *Torulaspora pretoriensis*, *Issatchenkia orientalis*, *Schizosaccharomyces* spp., including *S. pombe*, *Cryptococcus* spp., *Aspergillus* spp., *Neurospora* spp., or *Ustilago* spp. Sources of genes from anaerobic fungi include, but are not limited to, *Piromyces* spp., *Orpinomyces* spp., or *Neocallimastix* spp. Sources of prokaryotic enzymes that are useful include, but are not limited to, *Escherichia. coli*, *Zymomonas mobilis*, *Staphylococcus aureus*, *Bacillus* spp., *Clostridium* spp., *Corynebacterium* spp., *Pseudomonas* spp., *Lactococcus* spp., *Enterobacter* spp., *Salmonella* spp., or *X dendrorhous*.

Techniques known to those skilled in the art may be suitable to identify additional homologous genes and homologous enzymes. Generally, analogous genes and/or analogous enzymes can be identified by functional analysis and will have functional similarities. Techniques known to those skilled in the art can be suitable to identify analogous genes and analogous enzymes. Techniques include, but are not limited to, cloning a gene by PCR using primers based on a published sequence of a gene/enzyme of interest, or by degenerate PCR using degenerate primers designed to amplify a conserved region among a gene of interest. Further, one skilled in the art can use techniques to identify homologous or analogous genes, proteins, or enzymes with functional homology or similarity. Techniques include examining a cell or cell culture for the catalytic activity of an enzyme through in vitro enzyme assays for said activity, e.g., as described herein or in Kiritani, K., Branched-Chain Amino Acids Methods Enzymology, 1970; then isolating the enzyme with said activity through purification; determining the protein sequence of the enzyme through techniques such as Edman degradation; design of PCR primers to the likely nucleic acid sequence; amplification of said DNA sequence through PCR; and cloning of said nucleic acid sequence. To identify homologous or similar genes and/or homologous or similar enzymes, suitable techniques also include comparison of data concerning a candidate gene or enzyme with databases such as BRENDA, KEGG, or MetaCYC. The candidate gene or enzyme can be identified within the above mentioned databases in accordance with the teachings herein.

Methods of Producing Human Milk Oligosaccharides

Also provided herein are methods of producing one or more HMOs. The methods include providing a population of genetically modified yeast cells capable of producing one or more HMOs, which genetically modified yeast cells are also genetically modified to express an ABC transporter polypeptide, e.g., the polypeptide of SEQ ID NO: 1, 2, or 3, or a variant thereof as described herein; or the polypeptide of any one of SEQ ID NOS: 4-27, or a variant thereof as described herein. Each yeast cell of the population can include one more heterologous nucleic acids that encode the ABC transporter polypeptide and an enzyme of a HMO biosynthetic pathway. In some embodiments, the population includes any of the yeast cells as disclosed herein and discussed above. The methods further include providing a culture medium and culturing the yeast cells in the culture medium under conditions suitable for the yeast cells to produce the one or more milk oligosaccharides.

The culturing can be performed in a suitable culture medium in a suitable container, including but not limited to a cell culture plate, a flask, or a fermentor. Any suitable fermentor may be used, including, but not limited to, a stirred tank fermentor, an airlift fermentor, a bubble fermentor, or any combination thereof. In particular embodiments utilizing Saccharomyces cerevisiae as the host cell, strains can be grown in a fermentor as described in detail by Kosaric et al., in Ullmann's Encyclopedia of Industrial Chemistry, Sixth Edition, Volume 12, pages 398-473, Wiley-VCH Verlag GmbH & Co. KDaA, Weinheim, Germany. Further, the methods can be performed at any scale of fermentation known in the art to support industrial production of microbial products. Materials and methods for the maintenance and growth of cell cultures are well known to those skilled in the art of microbiology or fermentation science (see, for example, Bailey et al., Biochemical Engineering Fundamentals, second edition, McGraw Hill, New York, 1986). Consideration must be given to appropriate culture medium, pH, temperature, and requirements for aerobic, microaerobic, or anaerobic conditions, depending on the specific requirements of the host cell, the fermentation, and the process.

In some embodiments, the culturing is carried out for a period of time sufficient for the transformed population to undergo a plurality of doublings until a desired cell density is reached. In some embodiments, the culturing is carried out for a period of time sufficient for the host cell population to reach a cell density (OD600) of between 0.01 and 400 in the fermentation vessel or container in which the culturing is being carried out. The culturing can be carried out until the cell density is, for example, between 0.1 and 14, between 0.22 and 33, between 0.53 and 76, between 1.2 and 170, or between 2.8 and 400. In terms of upper limits, the culturing can be carried until the cell density is no more than 400, e.g., no more than 170, no more than 76, no more than 33, no more than 14, no more than 6.3, no more than 2.8, no more than 1.2, no more than 0.53, or no more than 0.23. In terms of lower limits, the culturing can be carried out until the cell density is greater than 0.1, e.g., greater than 0.23, greater than 0.53, greater than 1.2, greater than 2.8, greater than 6.3, greater than 14, greater than 33, greater than 76, or greater than 170. Higher cell densities, e.g., greater than 400, and lower cell densities, e.g., less than 0.1, are also contemplated.

In other embodiments, the culturing is carried for a period of time, for example, between 12 hours and 92 hours, e.g., between 12 hours and 60 hours, between 20 hours and 68 hours, between 28 hours and 76 hours, between 36 hours and 84 hours, or between 44 hours and 92 hours. In some embodiments, the culturing is carried out for a period of time, for example, between 5 days and 20 days, e.g., between 5 days and 14 days, between 6.5 days and 15.5 days, between 8 days and 17 days, between 9.5 days and 18.5 days, or between 11 days and 20 days. In terms of upper limits, the culturing can be carried out for less than 20 days, e.g., less than 18.5 days, less than 17 days, less than 15.5 days, less than 14 days, less than 12.5 day, less than 11 days, less than 9.5 days, less than 8 days, less than 6.5 days, less than 5 day, less than 92 hours, less than 84 hours, less than 76 hours, less than 68 hours, less than 60 hours, less than 52 hours, less than 44 hours, less than 36 hours, less than 28 hours, or less than 20 hours. In terms of lower limits, the culturing can be carries out for greater than 12 hours, e.g., greater than 20 hours, greater than 28 hours, greater than 36 hours, greater than 44 hours, greater than 52 hours, greater than 60 hours, greater than 68 hours, greater than 76 hours, greater than 84 hours, greater than 92 hours, greater than 5 days, greater than 6.5 days, greater than 8 days, greater than 9.5 days, greater than 11 days, greater than 12.5 days, greater than 14 days, greater than 15.5 days, greater than 17 days, or greater than 18.5 days. Longer culturing times, e.g., greater than 20 days, and shorter culturing times, e.g., less than 5 hours, are also contemplated.

In certain embodiments, the production of the one or more HMOs by the population of genetically modified yeast is inducible by an inducing compound. Such yeast can be manipulated with ease in the absence of the inducing compound. The inducing compound is then added to induce the production of the HMOs by the yeast. In other embodiments, production of the one or more HMOs by the yeast is inducible by changing culture conditions, such as, for example, the growth temperature, media constituents, and the like.

In certain embodiments, an inducing agent is added during a production stage to activate a promoter or to relieve repression of a transcriptional regulator associated with a biosynthetic pathway to promote production of HMOs. In certain embodiments, an inducing agent is added during a build stage to repress a promoter or to activate a transcriptional regulator associated with a biosynthetic pathway to repress the production of HMOs, and an inducing agent is removed during the production stage to activate a promoter to relieve repression of a transcriptional regulator to promote the production of HMOs. The term "genetic switch" is used herein to refer to the use of a promoter or other genetic elements to control activation or de-activation of the biosynthetic pathway for the one or more HMOs. Illustrative examples of useful inducing agents or genetic switches are described in, e.g., PCT Application Publications WO2015/020649, WO2016/210343, and WO2016210350, which are incorporated herein by reference in their entirety.

As discussed above, in some embodiments, the provided genetically modified yeast cell includes a promoter that regulates the expression and/or stability of at least one of the one or more heterologous nucleic acids. Thus, in certain embodiments, the promoter can be used to control the timing of gene expression and/or stability of proteins, for example, an ABC transporter polypeptide, e.g., the polypeptide of SEQ ID NO: 1, 2, or 3, or a variant thereof as described herein, or enzymes of a biosynthetic pathway for producing HMOs in genetically modified yeast cells during fermentation.

In some embodiments, when fermentation of a genetically modified yeast cell is carried out in the presence of a small molecule, e.g., at least about 0.1% maltose or lysine, HMO production is substantially reduced or turned off. When the amount of the small molecule in the fermentation culture medium is reduced or eliminated, HMO production is turned on or increased. Such a system enables the use of the presence or concentration of a selected small molecule in a fermentation medium as a switch for the production of non-catabolic, e.g., HMO, compounds. Controlling the timing of non-catabolic compound production to occur only when production is desired redirects the carbon flux during the non-production phase into cell maintenance and biomass. This more efficient use of carbon can greatly reduce the metabolic burden on the host cells, improve cell growth, increase the stability of the heterologous genes, reduce strain degeneration, and/or contribute to better overall health and viability of the cells.

In some embodiments, the fermentation method comprises a two-step process that utilizes a small molecule as a switch to affect the "off" and "on" stages. In the first step, i.e., the "build" stage, step (a) wherein production of the compound is not desired, the genetically modified yeast are grown in a growth or "build" medium comprising the small molecule in an amount sufficient to induce the expression of genes under the control of a responsive promoter, and the induced gene products act to negatively regulate production of the non-catabolic compound. After transcription of the fusion DNA construct under the control of a maltose-responsive or lysine-responsive promoter, the stability of the fusion proteins is post-translationally controlled. In the second step, i.e., the "production" stage, step (b), the fermentation is carried out in a culture medium comprising a carbon source wherein the small molecule is absent or in sufficiently low amounts such that the activity of a responsive promoter is reduced or inactive and the fusion proteins are destabilized. As a result, the production of the heterologous non-catabolic compound by the host cells is turned on or increased.

In other embodiments, a responsive promoter can be operably linked to one or more heterologous nucleic acids encoding one or more enzymes of a HMO pathway. The presence of an activating amount of the small molecule in the culture medium increases the expression of the one or more enzymes of the biosynthetic pathway. In these embodiments, the presence of a sufficient amount of maltose or lysine in the culture medium will increase expression of one or more enzymes of the biosynthetic pathway, and the fusion enzymes are stabilized in the presence of the small molecule.

In some embodiments, the culture medium is any culture medium in which a genetically modified yeast capable of producing an HMO can subsist, i.e., maintain growth and viability. In some embodiments, the culture medium is an aqueous medium comprising assimilable carbon, nitrogen, and phosphate sources. Such a medium can also include appropriate salts, minerals, metals, and other nutrients. In some embodiments, the carbon source and each of the essential cell nutrients, are added incrementally or continuously to the fermentation media, and each required nutrient is maintained at essentially the minimum level needed for efficient assimilation by growing cells, for example, in accordance with a predetermined cell growth curve based on the metabolic or respiratory function of the cells which convert the carbon source to a biomass.

In another embodiment, the method of producing HMOs comprises culturing host cells in separate build and production culture media. For example, the method can comprise culturing the genetically modified host cell in a build stage wherein the cell is cultured under non-producing conditions, e.g., non-inducing conditions, to produce an inoculum, then transferring the inoculum into a second fermentation medium under conditions suitable to induce HMO production, e.g., inducing conditions, and maintaining steady state conditions in the second fermentation stage to produce a cell culture containing HMOs.

In some embodiments, the culture medium comprises sucrose and lactose. In some embodiments, the carbon sources in the culture medium consist essentially of sucrose and lactose. In some embodiments, the carbon sources in the culture medium consist of sucrose and lactose. In some embodiments, the mass ratio of the sucrose to the lactose is selected to influence, adjust, or control the relative production rates of HMOs produced by the yeast cells. Controlling the composition of the produced HMOs in this way can advantageously permit the increasing of desired products, the decreasing of undesired products, the targeting of a desired product ratio, and the simplification of downstream product separation processes.

The mass ratio of the sucrose to the lactose in the culture medium can be, for example, between 4 and 40, e.g., between 4 and 25.6, between 7.6 and 29.2, between 11.2 and 32.8, between 14.8 and 36.4, or between 18.4 and 40. In terms of upper limits, the mass ratio of the sucrose to the lactose can be less than 40, e.g., less than 36.4, less than 32.8, less than 29.2, less than 25.6, less than 22, less than 18.4, less than 14.8, less than 11.2, or less than 7.6. In terms of lower limits, the mass ratio of the sucrose to the lactose can be greater than 4, e.g., greater than 7.6, greater than 11.2, greater than 14.8, greater than 18.4, greater than 22, greater than 25.6, greater than 29.2, greater than 32.8, or greater than 36.4. Higher ratios, e.g., greater than 40, and lower ratios, e.g., less than 4, are also contemplated.

Sources of assimilable nitrogen that can be used in a suitable culture medium include, but are not limited to, simple nitrogen sources, organic nitrogen sources and complex nitrogen sources. Such nitrogen sources include anhydrous ammonia, ammonium salts and substances of animal, vegetable and/or microbial origin. Suitable nitrogen sources include, but are not limited to, protein hydrolysates, microbial biomass hydrolysates, peptone, yeast extract, ammonium sulfate, urea, and amino acids. Typically, the concentration of the nitrogen sources, in the culture medium is greater than about 0.1 g/L, preferably greater than about 0.25 g/L, and more preferably greater than about 1.0 g/L. In some embodiments, the addition of a nitrogen source to the culture medium beyond a certain concentration is not advantageous for the growth of the yeast. As a result, the concentration of the nitrogen sources, in the culture medium can be less than about 20 g/L, e.g., less than about 10 g/L or less than about 5 g/L. Further, in some instances it may be desirable to allow the culture medium to become depleted of the nitrogen sources during culturing.

The effective culture medium can contain other compounds such as inorganic salts, vitamins, trace metals or growth promoters. Such other compounds can also be present in carbon, nitrogen or mineral sources in the effective medium or can be added specifically to the medium.

The culture medium can also contain a suitable phosphate source. Such phosphate sources include both inorganic and organic phosphate sources. Preferred phosphate sources include, but are not limited to, phosphate salts such as mono or dibasic sodium and potassium phosphates, ammonium phosphate and mixtures thereof. Typically, the concentration of phosphate in the culture medium is greater than about 1.0 g/L, e.g., greater than about 2.0 g/L or greater than about 5.0 g/L. In some embodiments, the addition of phosphate to the culture medium beyond certain concentrations is not advantageous for the growth of the yeast. Accordingly, the concentration of phosphate in the culture medium can be less than about 20 g/L, e.g., less than about 15 g/L or less than about 10 g/L.

A suitable culture medium can also include a source of magnesium, preferably in the form of a physiologically acceptable salt, such as magnesium sulfate heptahydrate, although other magnesium sources in concentrations that contribute similar amounts of magnesium can be used. Typically, the concentration of magnesium in the culture medium is greater than about 0.5 g/L, e.g., greater than about 1.0 g/L or greater than about 2.0 g/L. In some embodiments, the addition of magnesium to the culture medium beyond certain concentrations is not advantageous for the growth of the yeast. Accordingly, the concentration of magnesium in the culture medium can be less than about 10 g/L, e.g, less than about 5 g/L or less than about 3 g/L. Further, in some instances it may be desirable to allow the culture medium to become depleted of a magnesium source during culturing.

In some embodiments, the culture medium can also include a biologically acceptable chelating agent, such as the dihydrate of trisodium citrate. In such instance, the concentration of a chelating agent in the culture medium can be greater than about 0.2 g/L, e.g., greater than about 0.5 g/L or greater than about 1 g/L. In some embodiments, the addition of a chelating agent to the culture medium beyond certain concentrations is not advantageous for the growth of the yeast. Accordingly, the concentration of a chelating agent in the culture medium can be less than about 10 g/L, e.g., less than about 5 g/L or less than about 2 g/L.

The culture medium can also initially include a biologically acceptable acid or base to maintain the desired pH of the culture medium. Biologically acceptable acids include, but are not limited to, hydrochloric acid, sulfuric acid, nitric acid, phosphoric acid and mixtures thereof. Biologically acceptable bases include, but are not limited to, ammonium hydroxide, sodium hydroxide, potassium hydroxide and mixtures thereof. In some embodiments, the base used is ammonium hydroxide.

The culture medium can also include a biologically acceptable calcium source, including, but not limited to, calcium chloride. Typically, the concentration of the calcium source, such as calcium chloride, dihydrate, in the culture medium is within the range of from about 5 mg/L to about 2000 mg/L, e.g., within the range of from about 20 mg/L to about 1000 mg/L or in the range of from about 50 mg/L to about 500 mg/L.

The culture medium can also include sodium chloride. Typically, the concentration of sodium chloride in the culture medium is within the range of from about 0.1 g/L to about 5 g/L, e.g., within the range of from about 1 g/L to about 4 g/L or in the range of from about 2 g/L to about 4 g/L.

In some embodiments, the culture medium can also include trace metals. Such trace metals can be added to the culture medium as a stock solution that, for convenience, can be prepared separately from the rest of the culture medium Typically, the amount of such a trace metals solution added to the culture medium is greater than about 1 ml/L, e.g., greater than about 5 mL/L, and more preferably greater than about 10 mL/L. In some embodiments, the addition of a trace metals to the culture medium beyond certain concentrations is not advantageous for the growth of the yeast. Accordingly, the amount of such a trace metals solution added to the culture medium can be less than about 100 mL/L, e.g., less than about 50 mL/L or less than about 30 mL/L. It should be noted that, in addition to adding trace metals in a stock solution, the individual components can be added separately, each within ranges corresponding independently to the amounts of the components dictated by the above ranges of the trace metals solution.

The culture media can include other vitamins, such as pantothenate, biotin, calcium, inositol, pyridoxine-HCl, thiamine-HCl, and combinations thereof. Such vitamins can be added to the culture medium as a stock solution that, for convenience, can be prepared separately from the rest of the culture medium In some embodiments, the addition of vitamins to the culture medium beyond certain concentrations is not advantageous for the growth of the yeast.

The fermentation methods described herein can be performed in conventional culture modes, which include, but are not limited to, batch, fed-batch, cell recycle, continuous and semi-continuous. In some embodiments, the fermentation is carried out in fed-batch mode. In such a case, some of the components of the medium are depleted during culture, e.g., during the production stage of the fermentation. In some embodiments, the culture may be supplemented with relatively high concentrations of such components at the outset, for example, of the production stage, so that growth and/or HMO production is supported for a period of time before additions are required. The preferred ranges of these components can be maintained throughout the culture by making additions as levels are depleted by culture. Levels of components in the culture medium can be monitored by, for example, sampling the culture medium periodically and assaying for concentrations. Alternatively, once a standard culture procedure is developed, additions can be made at timed intervals corresponding to known levels at particular times throughout the culture. As will be recognized by those of ordinary skill in the art, the rate of consumption of nutrient increases during culture as the cell density of the medium increases. Moreover, to avoid introduction of foreign microorganisms into the culture medium, addition can be performed using aseptic addition methods, as are known in the art. In addition, a small amount of anti-foaming agent may be added during the culture.

The temperature of the culture medium can be any temperature suitable for growth of the genetically modified yeast population and/or production of the one or more HMOs. For example, prior to inoculation of the culture medium with an inoculum, the culture medium can be brought to and maintained at a temperature in the range of from about 20° C. to about 45° C., e.g., to a temperature in the range of from about 25° C. to about 40° C. or of from about 28° C. to about 32° C. For example, the culture medium can be brought to and maintained at a temperature of 25° C., 25.5° C., 26° C., 26.5° C., 27° C., 27.5° C., 28° C., $^2$8.5° C., 29° C., 29.5° C., 30° C., 30.5° C., 31° C., 31.5° C., 32° C., 32.5° C. 33° C., 33.5° C. 34° C., 34.5° C., 35° C., 35.5° C., 36° C., 36.5° C., 37° C., 37.5° C., 38° C., 38.5° C., 39° C., 39.5° C., or 40° C.

The pH of the culture medium can be controlled by the addition of acid or base to the culture medium In such cases when ammonia is used to control pH, it also conveniently serves as a nitrogen source in the culture medium In some embodiments, the pH is maintained from about 3.0 to about 8.0, e.g., from about 3.5 to about 7.0 or from about 4.0 to about 6.5.

In some embodiments, the genetically modified yeast cells produce 2'-fucosyllactose. The concentration of produced 2'-fucosyllactose in the culture medium can be, for example, between 1 g/l and 125 g/l, e.g., between 5 g/l and 115 g/l, between 10 g/l and 110 g/l, between 15 g/l and 100 g/l, between 20 g/l and 100 g/l, or between 25 g/l and 100 g/l. In some embodiments, the concentration of produced 2'-fucosyllactose in the culture medium can be, for example, between 5 g/l and 100 g/l, e.g., between 5 g/l and 50 to 90 g/l, between 10 g/l and 80 g/l, between 10 g/l and 75 g/l, between 20 g/l and 80 g/l, or between 20 g/l and 80 g/l. In some embodiments, the 2'-fucosyllactose concentration can be greater than 5 g/l, e.g., greater than 8.5 g/l, greater than 12 g/l, greater than 15.5 g/l, greater than 19 g/l, greater than 22.5 g/l, greater than 26 g/l, greater than 29.5 g/l, greater than 33 g/l, or greater than 36.5 g/l. In some embodiments, concentrations of produced 2'-fucosyllactose can be 40 g/l or greater, e.g., 50 g/l, 60 g/l 70 g/l 80 g/l, 90 g/l e.g., or greater. For example, in some embodiments, concentrations of produced 2'-fucosyllactose in the culture medium can be 100 g/l or greater. In some embodiments, expression of an ABC transporter polypeptide, e.g., the polypeptide of SEQ ID NO: 1, 2, or 3, or a variant thereof as described herein, enhances production of 2'-fucosyllactose, compared to a counterpart control strain that is not modified to express the ABC transporter polypeptide, is enhanced by at least 5%, or at least 10%, 20%, 30%, 40%, 50%, 60%, 70%, 80%, 90%, 100%, or greater, compared to the control.

The yield of produced 2'-fucosyllactose on the sucrose in the culture medium can be, for example, between 0.01 g/g and 0.4 g/g, e.g., between 0.01 g/g and 0.3 g/g, between 0.01 g/g and 0.2 g/g, between 0.02 g/g and 0.2 g/g, between 0.03 g/g and 0.2 g/g, between 0.04 g/g and 0.2 g/g, or between 0.04 g/g and 0.2 g/g. In terms of lower limits, the yield of 2'-fucosyllactose on sucrose can be greater than 0.01 g/g, e.g., greater than 0.02 g/g, greater than 0.03 g/g, greater than 0.04 g/g, greater than 0.05 g/g, greater than 0.06 g/g, greater than 0.07 g/g, greater than 0.08 g/g, or greater than 0.09 g/g. Higher yields, e.g., greater than 0.1 g/g, or greater than 0.15, or greater than 0.2 g/g, are also contemplated. For example, in some embodiments, yields are at least 0.25 g/g, e.g., 0.25 g/g or 0.26 g/g, or greater. In some embodiments, expression of an ABC transporter polypeptide, e.g., the polypeptide of SEQ ID NO: 1, 2, or 3, or a variant thereof as described herein, enhances production of 2'-fucosyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 4-27, or a variant thereof as described herein, enhances production of 2'-fucosyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

In some embodiments, the genetically modified yeast cells produce difucosyllactose. The concentration of produced difucosyllactose in the culture medium can be, for example, between 5 g/l and 40 g/l, e.g., between 5 g/l and 26 g/l, between 8.5 g/l and 29.5 g/l, between 12 g/l and 33 g/l, between 15.5 g/l and 36.5 g/l, or between 19 g/l and 40 g/l. In terms of upper limits, the 2'-fucosyllactose concentration can be greater than 5 g/l, e.g., greater than 8.5 g/l, greater than 12 g/l, greater than 15.5 g/l, greater than 19 g/l, greater than 22.5 g/l, greater than 26 g/l, greater than 29.5 g/l, greater than 33 g/l, or greater than 36.5 g/l. Higher concentrations, e.g., greater than 40 g/l, are also contemplated.

In some embodiments, it is desirable to minimize the amount of difucosyllactose produced by the genetically modified yeast cells relative the amount of 2'-fucosyllactose produced. The mass of difucosyllactose produced by the yeast cells per g of 2'-fucosyllactose produced by the yeast cells can be, for example, between 0.001 g and 5 g e.g., between 0.01 g and 5 g, between 0.1 g and 5 g, between 0.2 g and 4.2 g, between 0.2 g and 2.6 g, between 0.6 g and 3 g, between 1 g and 3.4 g, between 1.4 g and 3.8 g, or between 1.8 g and 4.2 g. In terms of upper limits, the mass of difucosyllactose produced per g of 2'-fucosyllactose can be less than 4.2 g, e.g., less than 3.8 g, less than 3.4 g, less than 3 g, less than 2.6 g, less than 2.2 g, less than 1.8 g, less than 1.4 g, less than 1 g, less than 0.6 g, or less than 0.2 g. In terms of lower limits, the mass of difucosyllactose produced per g of 2'-fucosyllactose can be greater than 0.2 g, e.g., greater than 0.6 g, greater than 1 g, greater than 1.4 g, greater than 1.8 g, greater than 2.2 g, greater than 2.6 g, greater than 3 g, greater than 3.4 g, or greater than 3.8 g. Higher mass ratios, e.g., greater than 4.2 g/g, and lower mass ratios, e.g., less than 0.2 g/g, are also contemplated.

In some embodiments, the genetically modified yeast cells produce lacto-N-tetraose. The concentration of produced lacto-N-tetraose in the culture medium can be, for example, between 0.5 g/l and 8 g/l, e.g., between 0.5 g/l and 2.6 g/l, between 0.7 g/l and 3.5 g/l, between 0.9 g/l and 4.6 g/l, between 1.1 g/l and 6.1 g/l, or between 1.5 g/l and 8 g/l. In terms of upper limits, the lacto-N-tetraose concentration can be greater than 0.5 g/l, e.g., greater than 0.7 g/l, greater than 0.9 g/l, greater than 1.1 g/l, greater than 1.5 g/l, greater than 2 g/l, greater than 2.6 g/l, greater than 3.5 g/l, greater than 4.6 g/l, or greater than 6 g/l. Higher concentrations, e.g., greater than 8 g/l, are also contemplated. In some embodiments, expression of an ABC transporter polypeptide, e.g., the polypeptide of SEQ ID NO: 1, 2, or 3, or a variant thereof as described herein, enhances production of lacto-N-tetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 4-27, or a variant thereof as described herein, enhances production of lacto-N-tetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 28-98, or a variant thereof as described herein, enhances production of lacto-N-tetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

In some embodiments, the genetically modified yeast cells produce lacto-N-neotetraose. The concentration of produced lacto-N-neotetraose in the culture medium can be, for example, between 0.5 g/l and 30 g/l, e.g., between 0.5 g/l and 5.8 g/l, between 0.8 g/l and 8.8 g/l, between 1.1 g/l and 13 g/l, between 1.7 g/l and 20 g/l, or between 2.6 g/l and 30 g/l. In terms of upper limits, the lacto-N-neotetraose concentration can be greater than 0.5 g/l, e.g., greater than 0.8 g/l, greater than 1.1 g/l, greater than 1.7 g/l, greater than 2.6 g/l, greater than 3.9 g/l, greater than 5.8 g/l, greater than 8.8 g/l, greater than 13 g/l, or greater than 20 g/l. Higher concentrations, e.g., greater than 30 g/l, are also contemplated. In some embodiments, expression of an ABC transporter polypeptide, e.g., the polypeptide of SEQ ID NO: 1, 2, or 3, or a variant thereof as described herein, enhances production of lacto-N-neotetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 4-27, or a variant thereof as described herein, enhances production of lacto-N-neotetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 28-98, or a variant thereof as described herein, enhances production of lacto-N-tetraose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

In some embodiments, the genetically modified yeast cells produce 3-fucosyllactose. The concentration of produced 3-fucosyllactose in the culture medium can be, for example, between 0.05 g/l and 3 g/l, e.g., between 0.05 g/l and 2 g/l, between 0.07 g/l and 0.35 g/l, between 0.09 g/l and 0.46 g/l, between 0.11 g/l and 0.61 g/l, or between 0.15 g/l and 0.8 g/l. In terms of upper limits, the 3-fucosyllactose concentration can be greater than 0.05 g/l, e.g., greater than 0.07 g/l, greater than 0.09 g/l, greater than 0.11 g/l, greater than 0.15 g/l, greater than 0.2 g/l, greater than 0.26 g/l, greater than 0.35 g/l, greater than 0.46 g/l, or greater than 0.6 g/l. Higher concentrations, e.g., greater than 0.8 g/l, are also contemplated. In some embodiments, expression of an ABC transporter polypeptide, e.g., the polypeptide of SEQ ID NO: 1, 2, or 3, or a variant thereof as described herein, enhances production of 3-fucosyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 4-27, or a variant thereof as described herein, enhances production of 3-fucosyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

In some embodiments, the genetically modified yeast cells produce 3'-sialyllactose. The concentration of produced 3'-sialyllactose in the culture medium can be, for example, between 0.1 g/l and 1.6 g/l, e.g., between 0.1 g/l and 0.53 g/l, between 0.13 g/l and 0.7 g/l, between 0.17 g/l and 0.92 g/l, between 0.23 g/l and 1.2 g/l, or between 0.3 g/l and 1.6 g/l. In terms of upper limits, the 3'-sialyllactose concentration can be greater than 0.1 g/l, e.g., greater than 0.13 g/l, greater than 0.17 g/l, greater than 0.23 g/l, greater than 0.3 g/l, greater than 0.4 g/l, greater than 0.53 g/l, greater than 0.7 g/l, greater than 0.92 g/l, or greater than 1.2 g/l. Higher concentrations, e.g., greater than 1.6 g/l, are also contemplated. In some embodiments, expression of an ABC transporter polypeptide, e.g., the polypeptide of SEQ ID NO: 1, 2, or 3, or a variant thereof as described herein, enhances production of 3'-sialyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

In some embodiments, the genetically modified yeast cells produce 6'-sialyllactose. The concentration of produced 6'-sialyllactose in the culture medium can be, for example, between 0.25 g/l and 20 g/l, e.g., between 0.25 g/l and 15 g/l, between 0.33 g/l and 20 g/l, between 0.44 g/l and 20 g/l, between 0.57 g/l and 20 g/l, or between 0.76 g/l and 20 g/l. In terms of upper limits, the 3'-sialyllactose concentration can be greater than 20 g/l, e.g., or greater than 10 g/l. Higher concentrations, e.g., greater than 20 g/l, are also contemplated. In some embodiments, expression of an ABC transporter polypeptide, e.g., the polypeptide of SEQ ID NO: 1, 2, or 3, or a variant thereof as described herein, enhances production of 6'-sialyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 4-27, or a variant thereof as described herein, enhances production of 6'-sialyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control. In some embodiments, expression of an ABC transporter polypeptide, e.g., the polypeptide of any one of SEQ ID NOS: 99-126, or a variant thereof as described herein, enhances production of 6'-sialyllactose, compared to a counterpart control strain that is not modified to express the ABC transporter polypeptide, by at least 5%, or at least 10%, 20%, 30%, 40%, 50%, 60%, 70%, 80%, 90%, 100%, or greater, compared to the control.

Fermentation Compositions

Also provided are fermentation compositions including a population of genetically modified yeast cells. The yeast cells can include any of the yeast cells disclosed herein and discussed above. In some embodiments, the fermentation composition further includes at least one HMO produced from the yeast cells. The at least one HMO in the fermentation composition can include, for example, 2'-fucosyllactose, difucosyllactose, 3-fucosyllactose, lacto-N-tetraose, lacto-N-neotetraose, 3'-sialyllactose, or 6'-sialyllactose. In some embodiments, the fermentation composition includes at least two HMOs. The at least two HMOs in the fermentation composition can include, for example, 2'-fucosyllactose and difucosyllactose, 2'-fucosyllactose and 3-fucosyllactose, 2'-fucosyllactose and lacto-N-tetraose, 2'-fucosyllactose and lacto-N-neotetraose, 2'-fucosyllactose and 3'-sialyllactose, 2'-fucosyllactose and 6'-sialyllactose, difucosyllactose and 3-fucosyllactose, difucosyllactose and lacto-N-tetraose, difucosyllactose and lacto-N-neotetraose, difucosyllactose and 3'-sialyllactose, difucosyllactose and 6'-sialyllactose, 3-fucosyllactose and lacto-N-tetraose, 3-fucosyllactose and lacto-N-neotetraose, 3-fucosyllactose and 3'-sialyllactose, 3-fucosyllactose and 6'-sialyllactose, lacto-N-tetraose and lacto-N-neotetraose, lacto-N-tetraose and 3'-sialyllactose, lacto-N-tetraose and 6'-sialyllactose, lacto-N-neotetraose and 3'-sialyllactose, lacto-N-neotetraose and 6'-sialyllactose, or 3'-sialyllactose and 6'-sialyllactose.

In some embodiments, the fermentation composition includes at least three HMOs produced from the yeast cells. The at least three HMOs in the fermentation composition can include, for example, 2'-fucosyllactose, difucosyllactose, and 3-fucosyllactose; 2'-fucosyllactose, difucosyllactose, and lacto-N-tetraose; 2'-fucosyllactose, difucosyllactose, and lacto-N-neotetraose; 2'-fucosyllactose, difucosyllactose, and 3'-sialyllactose; 2'-fucosyllactose, difucosyllactose, and 6'-sialyllactose; 2'-fucosyllactose, 3-fucosyllactose, and lacto-N-tetraose; 2'-fucosyllactose, 3-fucosyllactose, and lacto-N-neotetraose; 2'-fucosyllactose, 3-fucosyllactose, and 3'-sialyllactose; 2'-fucosyllactose, 3-fucosyllactose, and 6'-sialyllactose; 2'-fucosyllactose, lacto-N-tetraose, and lacto-N-neotetraose; 2'-fucosyllactose, lacto-N-tetraose, and 3'-sialyllactose; 2'-fucosyllactose, lacto-N-tetraose, and 6'-sialyllactose; 2'-fucosyllactose, lacto-N-neotetraose, and 3'-sialyllactose; 2'-fucosyllactose, lacto-N-neotetraose, and 6'-sialyllactose; 2'-fucosyllactose, 3'-sialyllactose, and 6'-sialyllactose; difucosyllactose, 3-fucosyllactose, and lacto-N-tetraose; difucosyllactose, 3-fucosyllactose, and lacto-N-neotetraose; difucosyllactose, 3-fucosyllactose, and 3'-sialyllactose; difucosyllactose, 3-fucosyllactose, and 6'-sialyllactose; difucosyllactose, lacto-N-tetraose, and lacto-N-neotetraose; difucosyllactose, lacto-N-tetraose, and 3'-sialyllactose; difucosyllactose, lacto-N-tetraose, and 6'-sialyllactose; difucosyllactose, lacto-N-neotetraose, and 3'-sialyllactose; difucosyllactose, lacto-N-neotetraose, and 6'-sialyllactose; difucosyllactose, 3'-sialyllactose, and 6'-sialyllactose; 3-fucosyllactose, lacto-N-tetraose, and lacto-N-neotetraose; 3-fucosyllactose, lacto-N-tetraose, and 3'-sialyllactose; 3-fucosyllactose, lacto-N-tetraose, and 6'-sialyllactose; 3-fucosyllactose, lacto-N-neotetraose, and 3'-sialyllactose; 3-fucosyllactose, lacto-N-neotetraose, and 6'-sialyllactose; 3-fucosyllactose, 3'-sialyllactose, and 6'-sialyllactose; lacto-N-tetraose, lacto-N-neotetraose, and 3'-sialyllactose; lacto-N-tetraose, lacto-N-neotetraose, and 6'-sialyllactose; or lacto-N-neotetraose, 3'-sialyllactose, and 6'-sialyllactose. In some embodiments, the fermentation composition includes at least four HMOs produced from the yeast cells. In some embodiments, the fermentation composition includes at least five HMOs produced from the yeast cells. In some embodiments, the fermentation composition includes at least six HMOs produced from the yeast cells. In some embodiments, the fermentation composition includes at least seven HMOs produced from the yeast cells.

The mass fraction of difucosyllactose within the one or more produced HMOs can be, for example, between 0 and 50%, e.g., between 0 and 30%, between 5% and 35%, between 10% and 40%, between 15% and 45%, or between 20% and 40%. In terms of upper limits, the mass fraction of difucosyllactose in the HMOs can be less than 50%, e.g., less than 45%, less than 40%, less than 35%, less than 30%, less than 25%, less than 20%, less than 15%, less than 10%, or less than 5%.

Methods of Recovering Human Milk Oligosaccharides

Also provided are methods of recovering one or more HMOs from a fermentation composition. In some embodiments, the fermentation composition is any of the fermentation composition disclosed herein and described above. The method includes separating at least a portion of a population of yeast cells from a culture medium. In some embodiments, the separating includes centrifugation. In some embodiments, the separating includes filtration.

While some portion of the one or more HMOs produced by the cells during fermentation can be expected to partition with the culture medium during the separation of the yeast cells from the medium, some of the HMOs can be expected to remain associated with the yeast cells. One approach to capturing this cell-associated product and improving overall recovery yields is to rinse the separated cells with a wash solution that is then collected. It has now been found that the effectiveness of such a rinse can be significantly increased by heating the wash solution prior to its use.

Accordingly, the provided recovery methods further include contacting the separated yeast cells with a heated wash liquid. In some embodiments, the heated wash liquid is a heated aqueous wash liquid. In some embodiments, the heated wash liquid consists of water. In some embodiments, the heated wash liquid includes one or more other liquid or dissolved solid components.

The temperature of the heated aqueous wash liquid can be, for example, between 30° C. and 90° C., e.g., between 30° C. and 66° C., between 36° C. and 72° C., between 42° C. and 78° C., between 48° C. and 84° C., or between 54° C. and 90° C. In terms of upper limits, the wash temperature can be less than 90° C., e.g., less than 84° C., less than 78° C., less than 72° C., less than 66° C., less than 60° C., less than 54° C., less than 48° C., less than 42° C., or less than 36° C. In terms of lower limits, the wash temperature can be greater than 30° C., e.g., greater than 36° C., greater than 42° C., greater than 48° C., greater than 54° C., greater than 60° C., greater than 66° C., greater than 72° C., greater than 78° C., or greater than 84° C. Higher temperatures, e.g., greater than 90° C., and lower temperatures, e.g., less than 30° C., are also contemplated.

The method further includes, subsequent to the contacting of the separated yeast cells with the heated wash liquid, removing the wash liquid from the yeast cells. In some embodiments, the removed wash liquid is combined with the separated culture medium and further processed to isolate the produced one or more HMOs. In some embodiments, the removed wash liquid and the separated culture medium are further processed independently of one another. In some embodiments, the removal of the wash liquid from the yeast cells includes centrifugation. In some embodiments, the removal of the wash liquid from the yeast cells includes filtration.

The recovery yield can be such that, for at least one of the one or HMOs produced from the yeast cells, the mass fraction of the produced at least one HMO recovered in the combined culture medium and wash liquid is, for example, between 70% and 100%, e.g., between 70% and 88%, between 73% and 91%, between 76% and 94%, between 79% and 97%, or between 82% and 100%. In terms of lower limits, the recovery yield of at least one of the one or more HMOs can be greater than 70%, e.g., greater than 73%, greater than 76%, greater than 79%, greater than 82%, greater than 85%, greater than 88%, greater than 91%, greater than 94%, or greater than 97%. The recovery yield can be such that, for each of the one or more HMOs produced from the yeast cells, the mass fraction recovered in the combined culture medium and wash liquid is, for example, between 70% and 100%, e.g., between 70% and 88%, between 73% and 91%, between 76% and 94%, between 79% and 97%, or between 82% and 100%. In terms of lower limits, the recovery yield of each of the one or more HMOs can be greater than 70%, e.g., greater than 73%, greater than 76%, greater than 79%, greater than 82%, greater than 85%, greater than 88%, greater than 91%, greater than 94%, or greater than 97%.

While the compositions and methods provided herein have been described with respect to a limited number of embodiments, one or more features from any of the embodiments described herein or in the figures can be combined with one or more features of any other embodiment described herein in the figures without departing from the scope of the disclosure. No single embodiment is representative of all aspects of the methods or compositions. In certain embodiments, the methods can include numerous steps not mentioned herein. In certain embodiments, the methods do not include any steps not enumerated herein. Variations and modifications from the described embodiments exist.

Methods of Treating a Fermentation Composition

Also provided are methods of treating a fermentation composition. The treatment methods are particularly useful for increasing the yield of 2'-fucosyllactose within fermentation compositions that include difucosyllactose. In some embodiments, the fermentation composition is any of the fermentation composition disclosed herein and described above. The method includes providing a fermentation composition comprising difucosyllactose. The concentration of difucosyllactose in the fermentation composition can be as described above. The method further includes contacting the fermentation with an enzyme capable of converting difucosyllactose to 2'-fucosyllactose, e.g., an α1-3,4 fucosidase. The α1-3,4 fucosidase can be encoded by a gene engineered into a strain of the fermentation, such that the α1-3,4 fucosidase is expressed during the fermentation. The α1-3,4 fucosidase can be exogenously added to the fermentation composition as part of a downstream processing protocol. Suitable α1-3,4 fucosidase sources include, for example and without limitation, *Bacteroides thetaiotaomicron*, *Bifidobacterium bifidum*, *Bifidobacterium longum*, *Bifidobacterium longum* subsp. *infantis*, *Clostridium perfringens*, *Lactobacillus casei*, *Paenibacillus thiaminolyticus*, *Pseudomonas putida*, *Thermotoga maritima*, *Xanthomonas campestris* pv. *campestris*, *Arabidopsis thaliana*, and *Rattus norvegicus*.

The contacting of the fermentation composition with the α1-3,4 fucosidase is under conditions suitable for converting at least a portion of the difucosyllactose to 2'-fucosyllactose. The percentage of initial difucosyllactose converted by the α1-3,4 fucosidase can be, for example, between 20% and 100%, e.g., between 20% and 68%, between 28% and 76%, between 36% and 84%, between 44% and 92%, or between 52% and 100%. In terms of lower limits, the percent conversion of the difucosyllactose can be greater than 20%, e.g., greater than 28%, greater than 36%, greater than 44%, greater than 52%, greater than 60%, greater than 68%, greater than 76%, greater than 84%, or greater than 92%. In some embodiments, the fermentation composition further comprises 3-fucosyllactose, and the contacting of the fermentation composition with the α1-3,4 fucosidase also includes reducing the level of 3-fucosyllactose in the fermentation composition, further improving 2'-fucosyllactose purity in the composition.

All publications and patent applications mentioned in this specification are herein incorporated by reference to the same extent as if each individual publication or patent application was specifically and individually indicated to be incorporated by reference. Although the claimed subject matter has been described in some detail by way of illustration and example for purposes of clarity of understanding, it will be readily apparent to those of ordinary skill in the art in light of the teachings herein that certain changes and modifications may be made thereto without departing from the spirit or scope of the appended claims.

EXAMPLES

The present disclosure will be better understood in view of the following non-limiting examples. The following examples are intended for illustrative purposes only and do not limit in any way the scope of the present invention.

Figure 2:
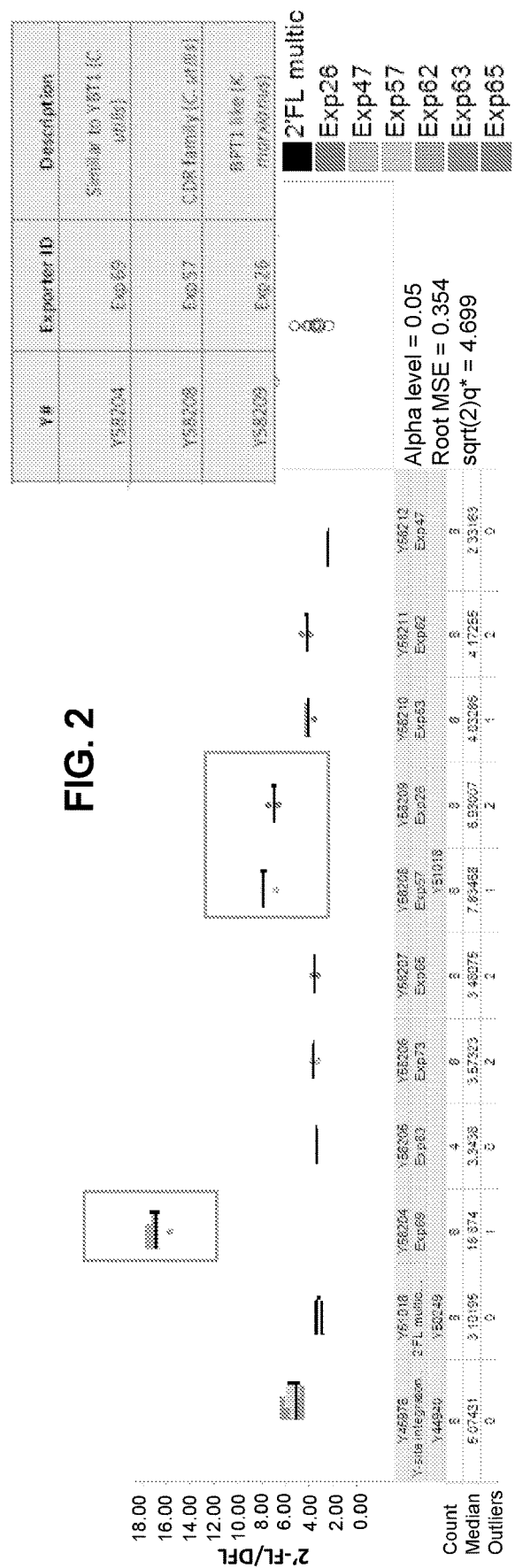
FIG. 2 provides data illustrating export activity in which the data are expressed as the ratio of 2'-fucosyllactose (2'-FL) to difucosyllactose (DFL). An increase in the 2'-FL to DFL ratio indicates that more 2'-FL is being exported.
Figure 3:
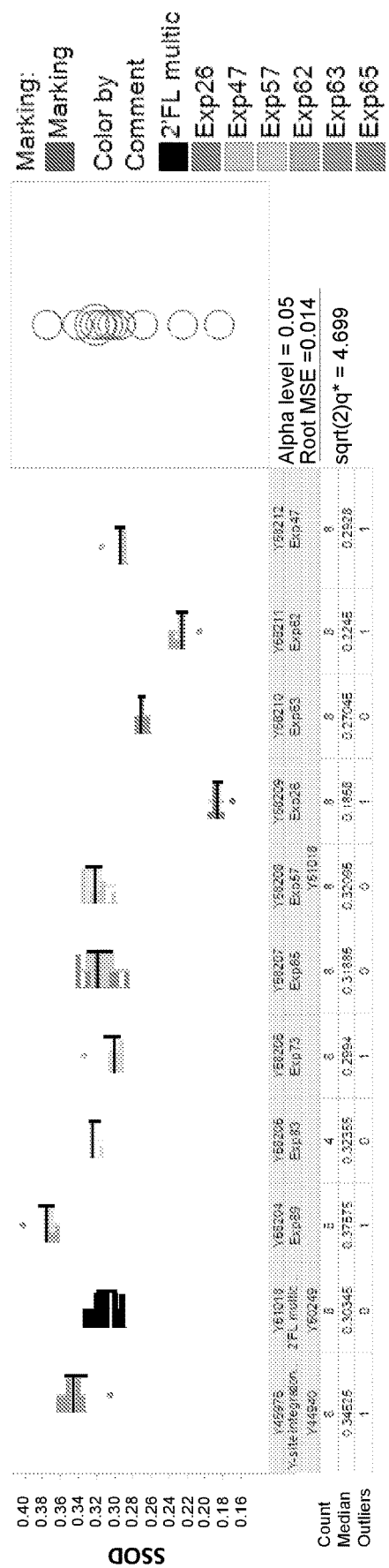
FIG. 3 provides data from an experiment evaluating effects of overexpression of exporter polypeptides on cell growth (optical density, SSOD).
Figure 6:
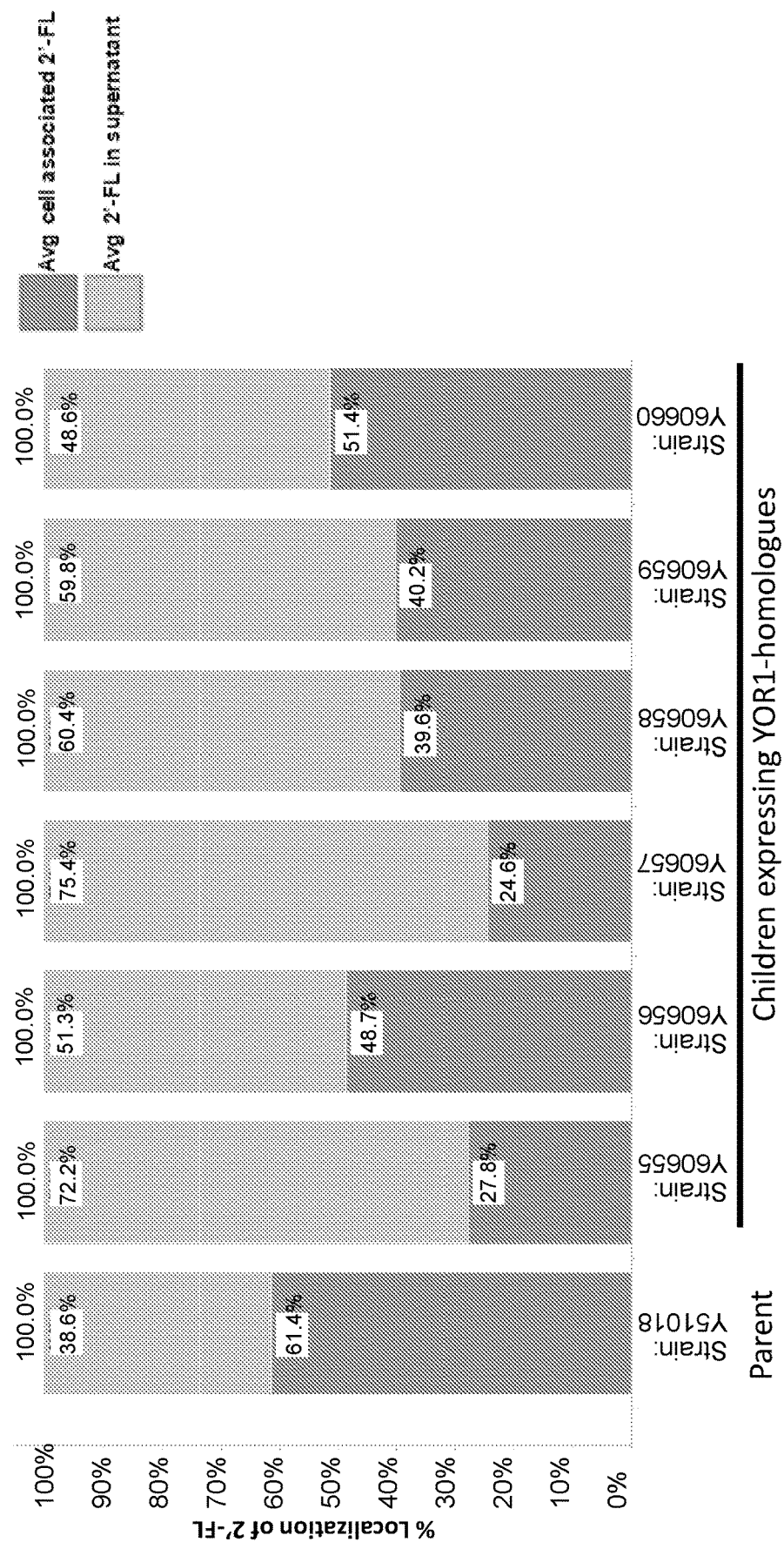
FIG. 6 provides data illustrating the average amount of 2'-FL in the supernatant relative to the average amount of 2'-FL associated with the cell in strains expressing an exporter polypeptide.

Example 1. 2'-Fucosyllactose Production in Strains Expressing Candidate Transporter (Export) Polypeptides Polynucleotides encoding candidate export proteins from various fungi were amplified for introducing into yeast strain to assess export activity driven by a GAL1 promoter. Activity was evaluated in yeast strain Y51018, which is genetically modified to produce 2'-fucosyllactose (2'-FL). The experiments were performed in 0.1% lactose to enhance difucosyllactose (DFL) detection. Transformants were assayed to identify those that exhibited reduced DFL and increased 2'-FL content. 2'-FL production strains were cultured for 3 days in growth media in 96-well shake plates and diluted into 96-well shake plates containing a sucrose/lactose minimal nutrient medium for oligosaccharide production. Cultures were shaken for 3 days, to sucrose exhaustion, the wells were extracted, analyzed by mass spectrometer, and quantitated by comparison to known standards. The results (FIG. 1) show that overexpression of three test export polypeptides, Exp 69 (amino acid sequence SEQ ID NO: 1), Exp 57 (amino acid sequence SEQ ID NO: 3) and Exp26 (amino acid sequence SEQ ID NO: 2) significantly improved product production, i.e., 2'-FL was increased and DFL was decreased compared to the parent Y51018 strain (see, also, 2'-FL/DFL ratio presented in FIG. 2). Exporter overexpression in this experiment exhibited various effects on growth (FIG. 3). Additionally. the ABC transporters were evaluated for export of 2'FL from the cell. The percentage of total 2'-FL found in the supernatant and the percentage of total 2'-FL associated with the cell were identified for 7 different strains (FIG. 6).

2'-FL production strains were cultured for 3 days in growth media in 96-well shake plates and diluted into 96-well shake plates containing a sucrose/lactose minimal nutrient medium for oligosaccharide production. Cultures were shaken for 3 days, to sucrose exhaustion, the wells were extracted, analyzed by mass spectrometer, and quantitated by comparison to known standards.

Figure 4:
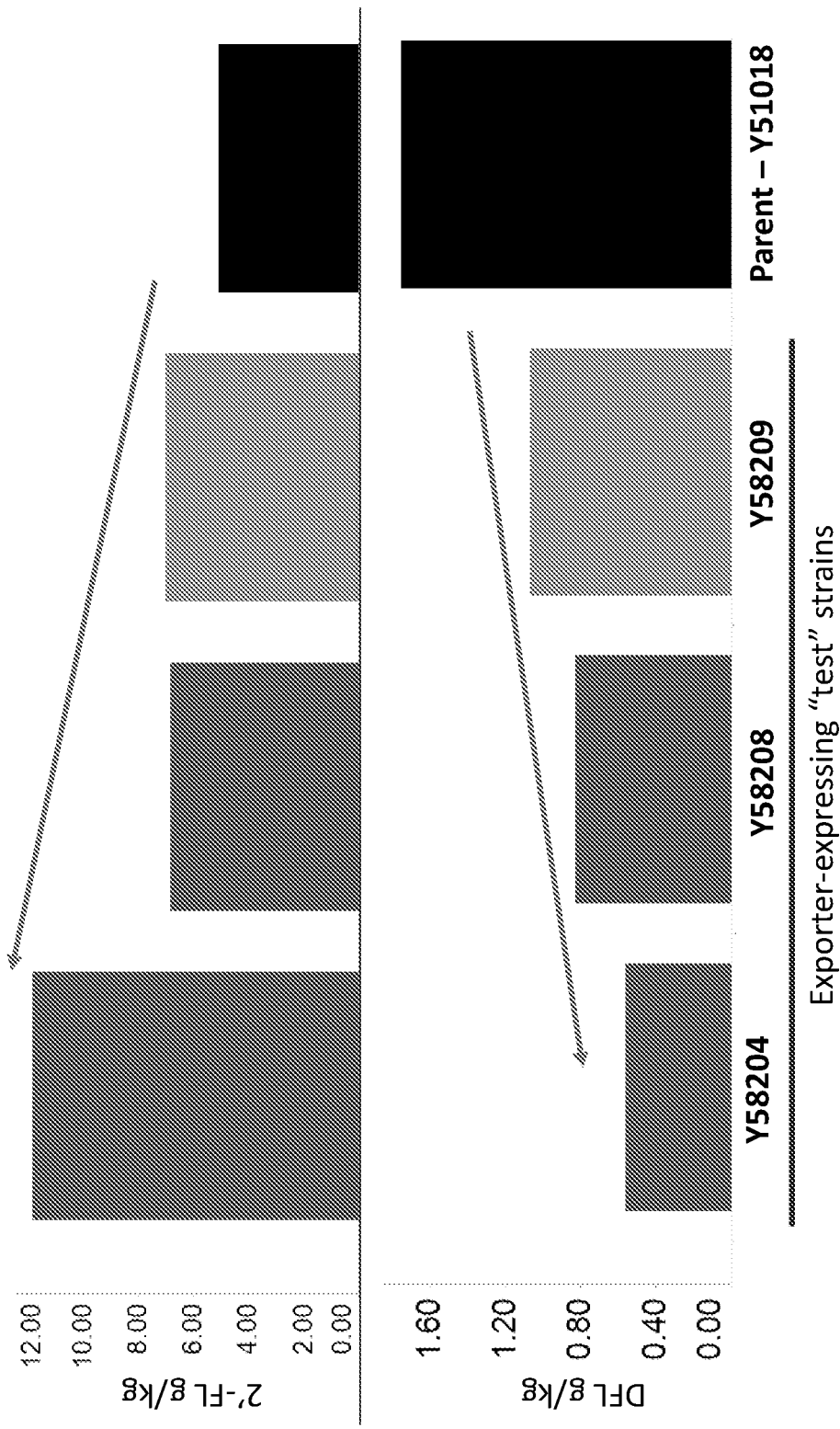
FIG. 4 provides data illustrating 2'-FL and DFL production by strains overexpressing exporter polypeptides under microfermentation conditions.
Figure 5:
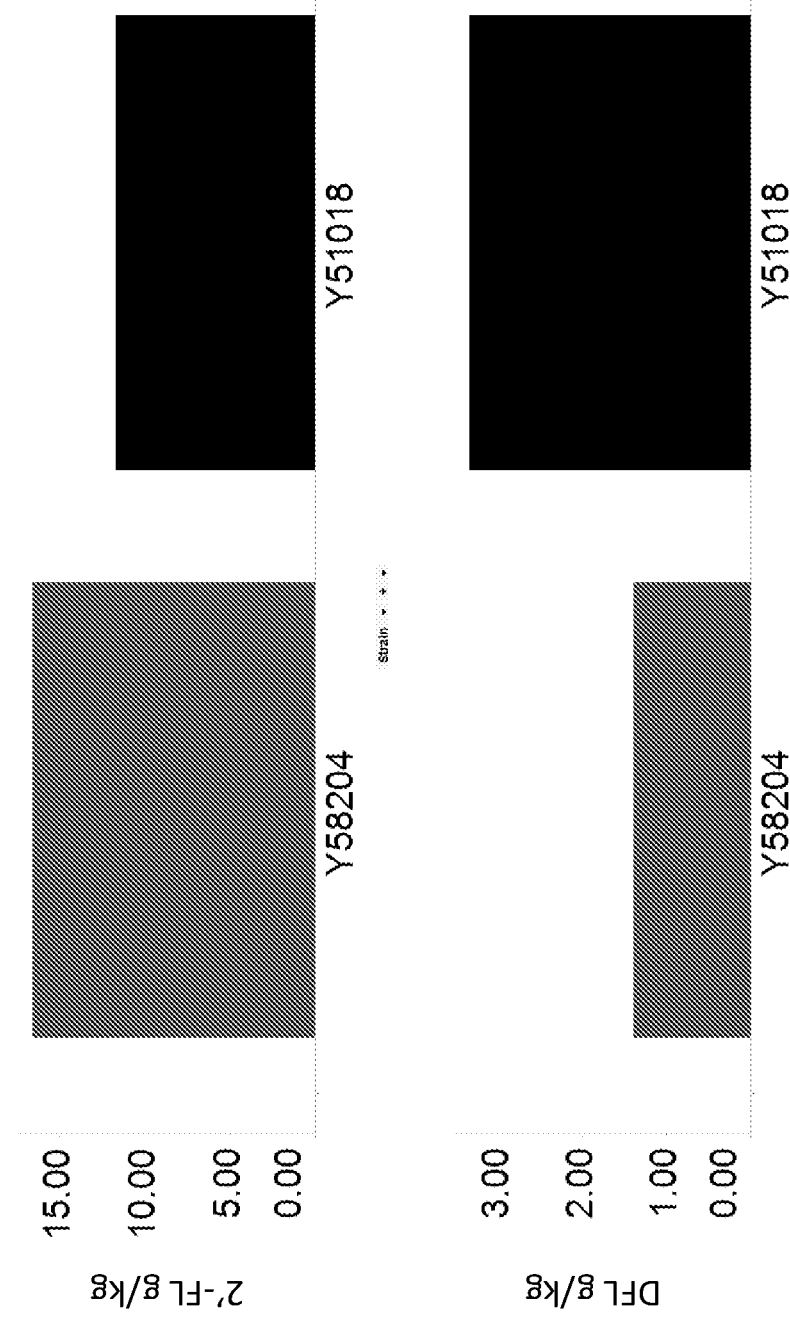
FIG. 5 provides data illustrating 2'-FL and DFL production by a strain overexpressing an exporter polypeptide compared to the parental strain when grown in bioreactors.
Figure 7B:
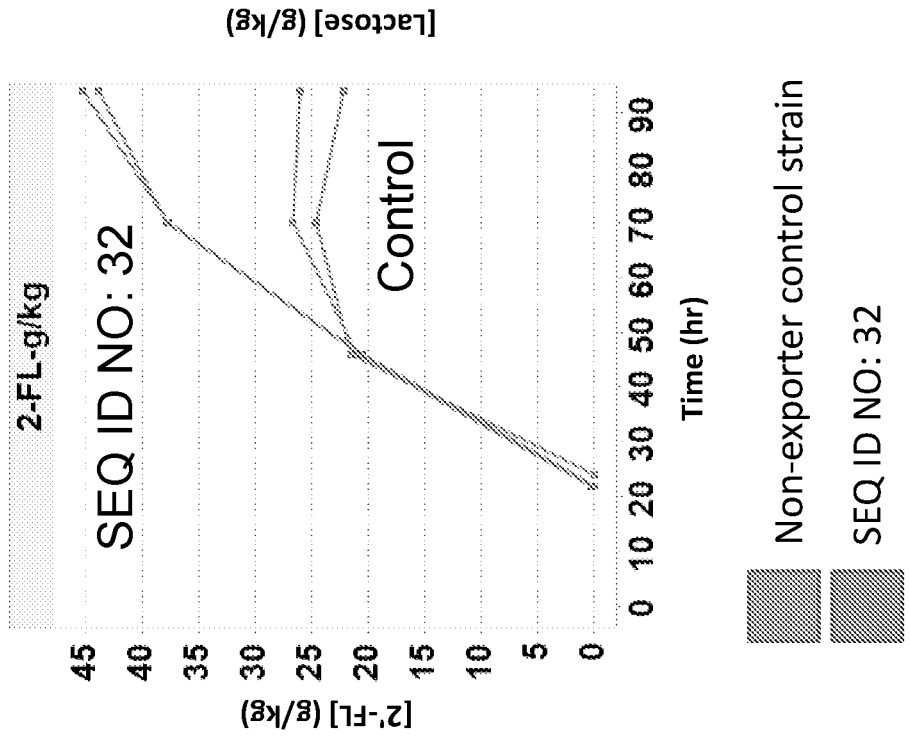
FIG. 7 are graphs showing the rate of oxygen uptake in mmol/L/hr (FIG. 7A) and the amount of 2'-FL produced (g/kg) (FIG. 7B)over time for a control yeast strain containing no heterologous ABC transporter in comparison to a yeast strain with YOR1 overexpression.
Figure 7A:
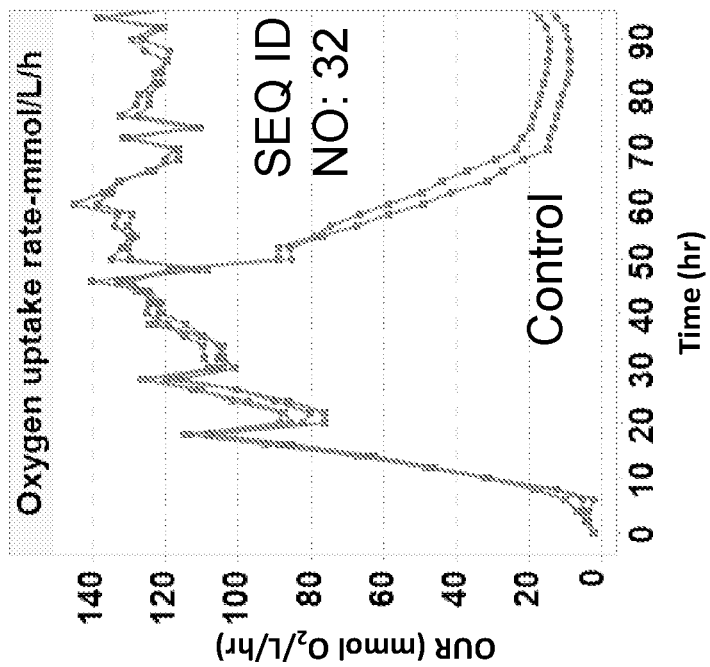

Y51018 strains that express the exporters Exp 69 (strain 58204), Exp 57 (strain Y58208) and Exp 26 (strain Y58209) were also evaluated in microfermentors. Each of the strains had higher 2'-FL g/kg content and reduced DFL content compared to parent strain Y51018 (FIG. 4). Y58204 was tested and the same effects were observed on a larger scale (FIG. 5). The overall effects on growth (FIG. 3) were also observed for each of the three test yeast strains (data not shown). Furthermore, when a yeast strain overexpressing the YOR1 transporter (having the amino acid sequence of SEQ ID NO: 32) was tested in a fermentor in comparison to a yeast strain with no heterologous ABC transporter, both the rate of oxygen uptake and amount of 2'-FL produced continued to increase over time (FIGS. 7A and 7B).

Strain Y58204 was also evaluated in microfermentors and larger fermentors for the accumulation of pathway intermediates in comparison to the parent strain Y51018. Y58204 exhibited pronounced reductions in fucose and another intermediate sugar compared to the parent strain (data not shown.). These results indicated that pathway flux mediated by the exporter reduces by-products.

This example thus demonstrated overall enhanced 2'-FL production by strains expressing transporter polypeptides (exporter strains). The results additionally indicated that the reduced intracellular 2'-FL observed in the exporter strains prevented reduced turnover by the fucosyltransferase; and that pathway flux (strain Y58204) was such that GDP-fucose, GDP-4-dehydro-6-deoxy-D-mannose did not accumulate, thus preventing accumulation of fucose and 4-dehydro-D-Rhamnose and generation of unusual di- or trisaccharides.

Additional ABC transporters (see, SEQ ID NOS:4-27) were also identified that enhance 2'FL production when overexpressed in a parent Y51018 strain in an initial microtiter plate analysis. In this experiment, the ratio of 2'-FL/DFL for the parent Y51018 strain was about 3. Ratios are shown below:

| Exporter overexpressed in Y51018: | 2'-FL/DFL ratio |
|---|---|
| *Naumovozyma castellii* SEQ ID NO: 24- | 10.16 |
| *Xylaria hypoxylon* SEQ ID NO: 23- | 5.05 |
| *Cyberlindnera jadinii* SEQ ID NO: 22- | 11.59 |
| *Clavispora lusitaniae* SEQ ID NO: 20- | 5.38 |
| *Metschnikowia bicuspidate* SEQ ID NO: 19- | 7.72 |
| *Clavispora lusitaniae* SEQ ID NO: 18- | 10.08 |
| *Issatchenkia orientalis* SEQ ID NO: 17- | 5.31 |

-continued

| Exporter overexpressed in Y51018: | 2'-FL/DFL ratio |
|---|---|
| *Wickerhamomyces ciferrii* SEQ ID NO: 15- | 6.24 |
| *Alternaria brassicicola* SEQ ID NO: 14- | 7.25 |
| *Cladosporium fulvum* SEQ ID NO: 13- | 7.68 |
| *Puccinia graminis f.sp.tritici* SEQ ID NO: 12- | 11.52 |
| *Lachancea mirantina* SEQ ID NO: 11- | 9.51 |
| *Debaryomyces hansenii* SEQ ID NO: 10- | 7.1 |
| *Cyberlindnera jadinii* SEQ ID NO: 5- | 4.92 |
| *Sclerotinia sclerotiorum* SEQ ID NO: 4- | 6.4 |
| *Debaryomyces fabryi* SEQ ID NO: 25- | 14.2 |
| *Wickerhamomyces ciferrii* SEQ ID NO: 9- | 17 |
| *Candida pseudohaemulonii* SEQ ID NO: 7- | 20 |
| *Candida haemulonis* SEQ ID NO: 6- | 12 |
| *Metschnikowia fructicola* SEQ ID NO: 8- | 23 |
| *Komagataella phaffii* SEQ ID NO: 16- | 17 |
| *Candida intermedia* SEQ ID NO: 21- | 20 |
| *Saccharomyces cerevisiae* SEQ ID NO: 26- | 21 |

Figure 8:
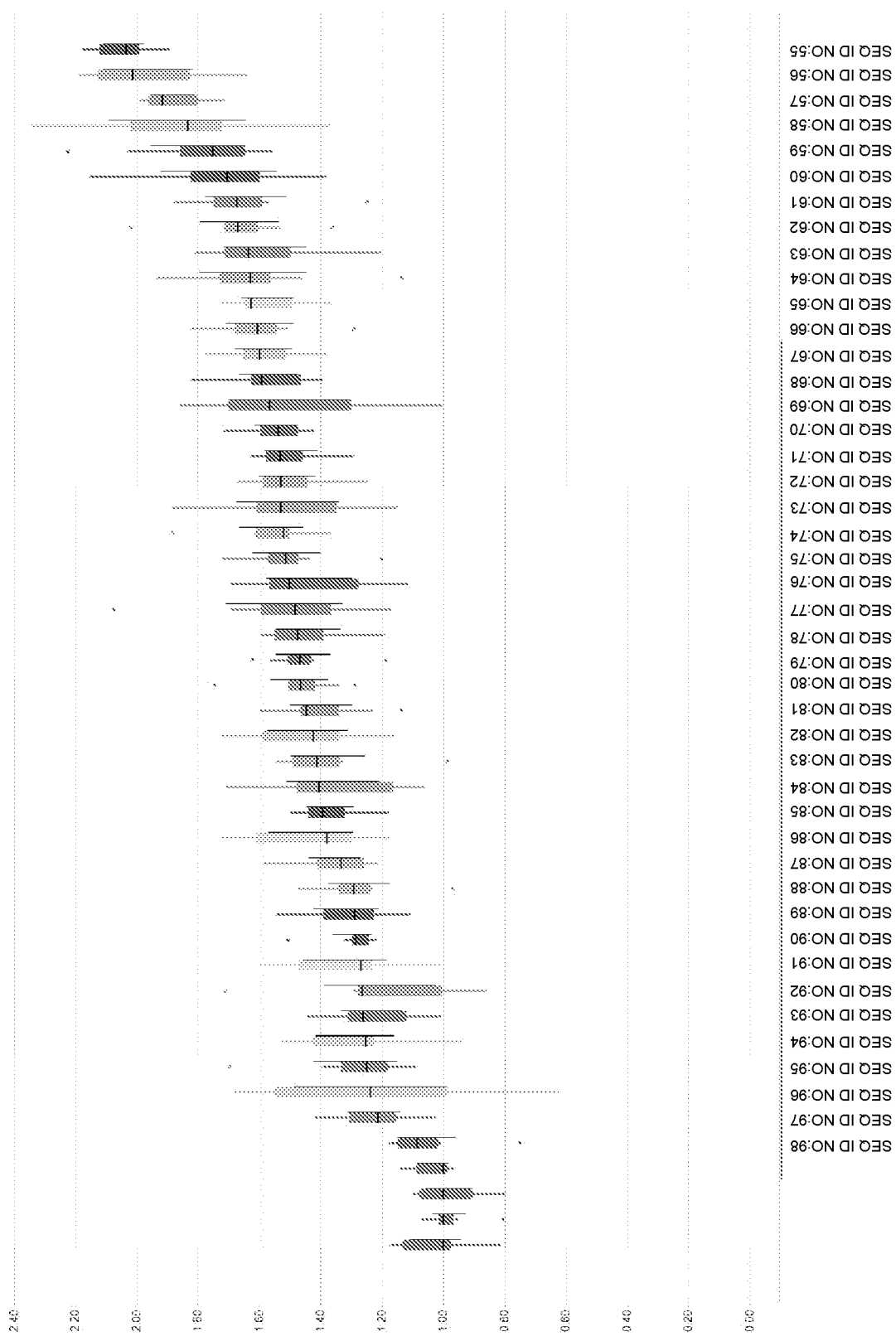
FIG. 8 is a graph showing the fold increase of lacto-N-neotetraose (LNnT) titer normalized by cell density (SSOD) for each of the top 44 highest performing ABC transporter proteins identified from a library of 113 transporter genes. The transporter genes were obtained from fungal sources and screened in yeast cells using a microtiter plate assay in accordance with the method set forth in Example 2, below. Each data point is a box plot showing the median and interquartile range values for lacto-N-neotetraose titer. The data points are labeled to indicate the amino acid sequence of the transporter protein that each yeast strain is modified to express. The boxed data points on the left of the x-axis represent replicate tests of the parent yeast strain with no heterologous transporter expressed (gray).

Example 2. Lacto-N-Neotetraose Production in Strains Expressing Candidate Transporter (Export) Polypeptides An assay was performed in a multi-tiered format to identify ABC transporters capable of lacto-N-neotetraose transport. The top ABC transporters from a first tier were carried on to a second tier in which the lacto-N-neotetraose experiments were performed with a greater number of replicates. The assay was performed by first obtaining yeast cells and subsequently modifying the cells to express enzymes necessary for the production of lacto-N-neotetraose. Next, the cells were further modified to express an HMO transporter from one of 113 different fungal sources. A yeast strain not modified to express a heterologous HMO transporter was also tested as a control. The cells were then cultured under conditions suitable for lacto-N-neotetraose production, and lacto-N-neotetraose titers were measured. The HMOs resulting in the highest titer from Tier 1 were then assessed. These results are shown in FIG. 8.

Specifically, a library of 113 transporter genes from fungal sources were screened in a Tier 1 microtiter plate assay using mass spectrometry. The top 44 hits from Tier 1, corresponding to SEQ ID NOS: 55-98, were promoted to Tier 2, which were then re-screened using a microtiter plate assay, with an increased number of replicates (n=8). A parent strain with no transporter was included for comparison. Transporters were considered hits if they increased lacto-N-neotetraose production per cell relative to the parent. As such, hits were ranked based on lacto-N-neotetraose titer normalized by cell density (SSOD). The top hit from this screen was a homolog of *S. cerevisiae* YBT1 from *H. polymorpha* (SEQ ID NO: 55) (FIG. 8).

Figure 9:
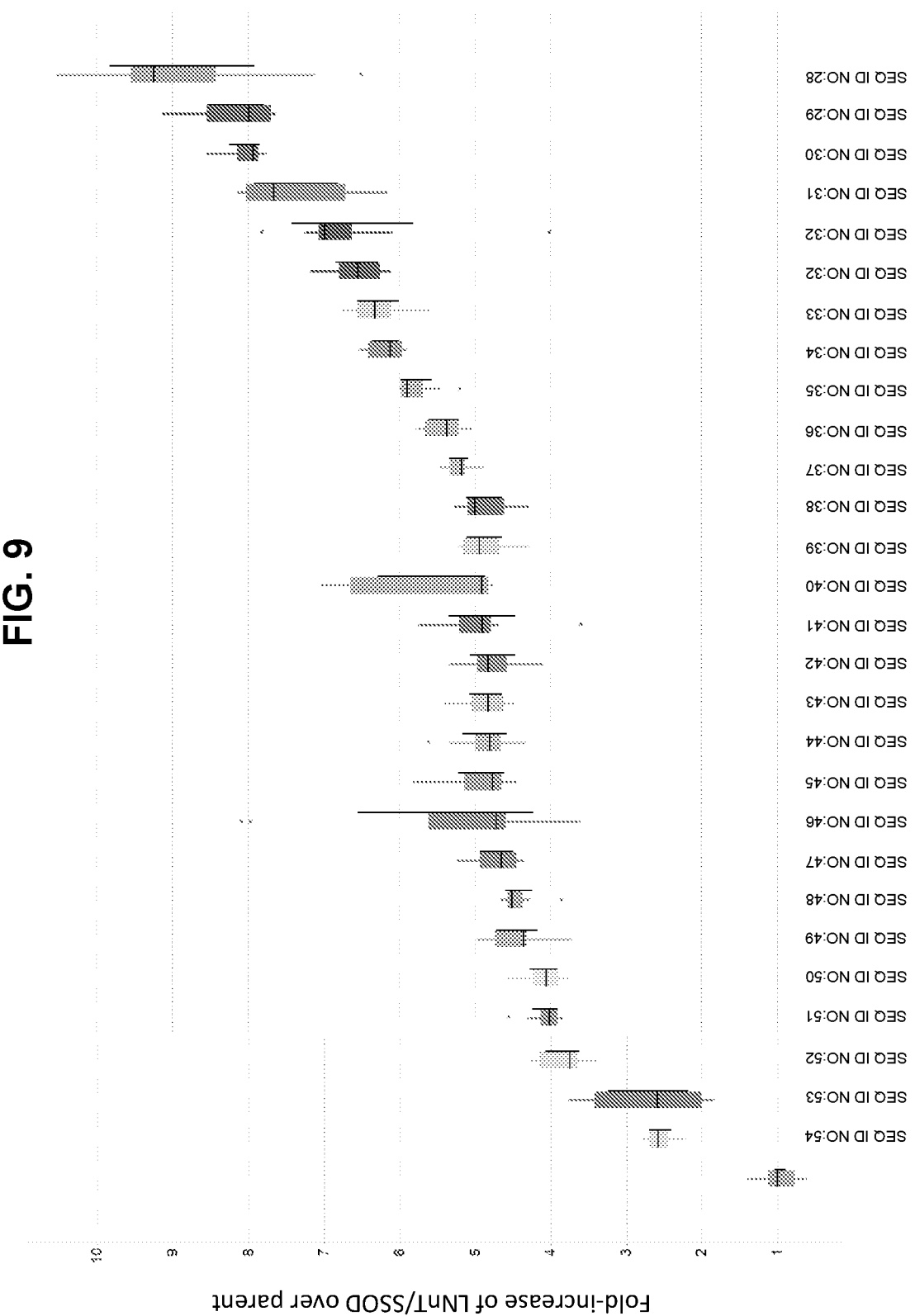
FIG. 9 is a graph showing the fold increase of LNnT titer normalized by cell density (SSOD) for each of the top 29 highest performing ABC transporter proteins identified from a library of 94 transporter genes. The transporter genes were obtained from a sequence library of S. cerevisiae YOR1 homologs and screened in yeast cells using a microtiter plate assay in accordance with the method set forth in Example 2, below. Each data point is a box plot showing the median and interquartile range values for lacto-N-neotetraose titer. The data points are labeled to indicate the amino acid sequence of the transporter protein that each yeast strain is modified to express. The boxed data point on the left of the x-axis represents a test of the parent yeast strain with no heterologous transporter expressed.
Figure 10:
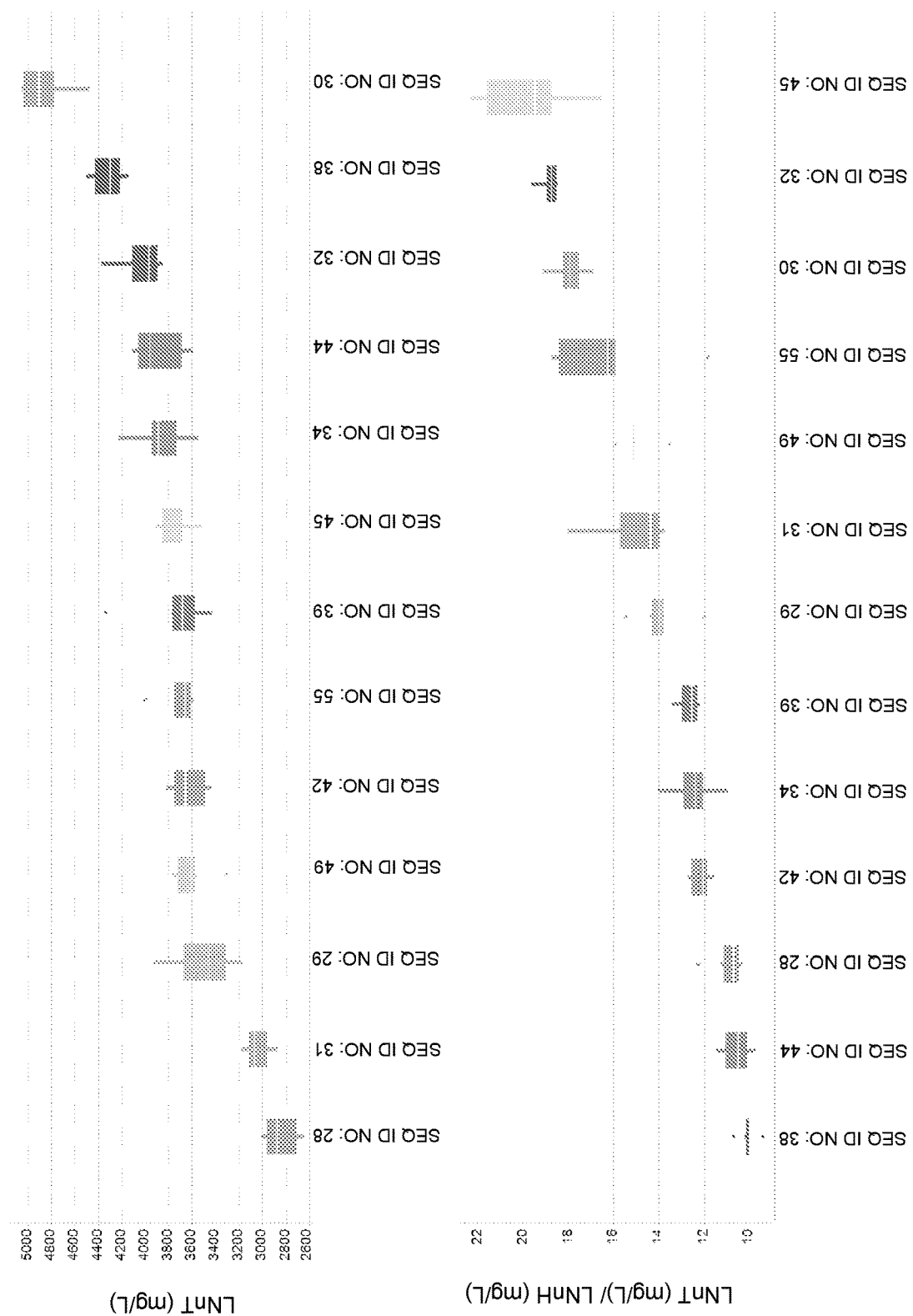
FIG. 10 provides data illustrating the amount of LNnT produced (in units of g/kg) from yeast strains overexpressing different ABC transporters (upper panel), and the ratio of LNnT produced in comparison to the amount of para-lacto-N-neohexaose (LNnH) produced (lower panel).

Additionally, 94 sequence homologs of *S. cerevisiae* YOR1 were screened in a Tier 1 microtiter plate assay using mass spectrometry. The top 29 hits from Tier 1, corresponding to SEQ ID NOS: 28-54, were promoted to Tier 2, which were then also screened using a microtiter plate assay using mass spectrometry, with an increased number of replicates (n=8). A parent strain with no transporter was included for comparison. Transporters which were considered hits increased lacto-N-neotetraose production per cell relative to the parent. As such, hits were ranked based on lacto-N-neotetraose titer normalized by cell density (SSOD). The top 12 hits from Tier 2, corresponding to SEQ ID NOS: 28-38, were promoted to Tier 3, which were retransformed into six additional backgrounds and screened using a microtiter plate assay using mass spectrometry. SEQ ID NOS: 28-32 showed the highest lacto-N-neotetraose titer in comparison to the parent strain with no transporter (FIG. 9). 12 different strains expressing different ABC transporters were evaluated with respect to the ratio of LNnT produced (g/kg) in comparison to the amount of para-lacto-N-neohexaose produced (FIG. 10, lower panel). Likewise, these strains, were evaluated with respect to the amount of LNnT each strain produced (FIG. 10, upper panel)

Figure 11A:
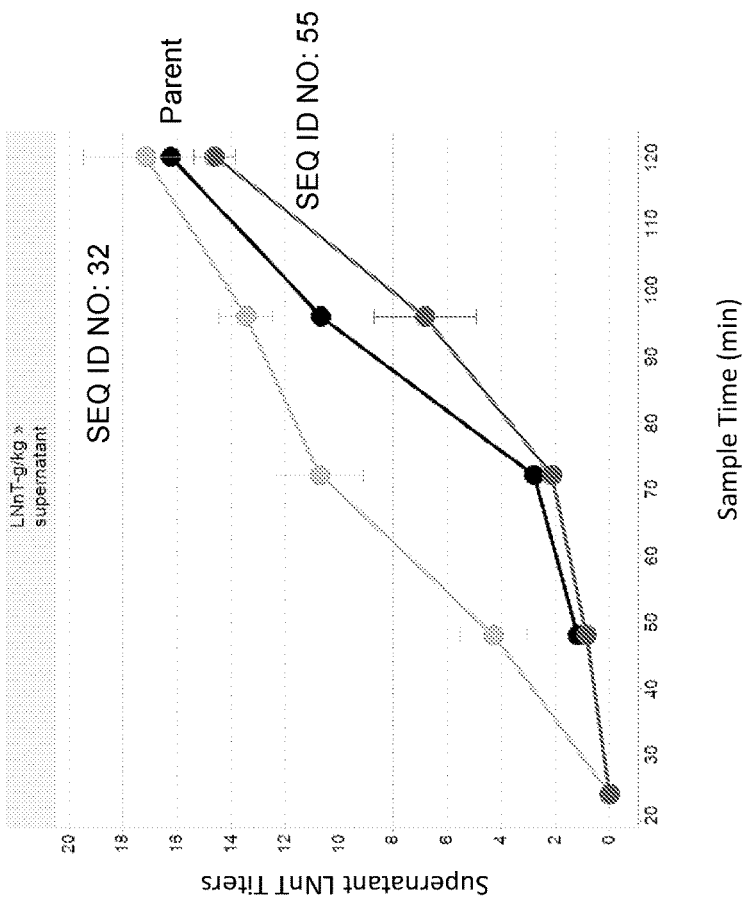
FIGS. 11A and 11B are graphs showing LNnT (in units of g/kg) in whole cell broth (FIG. 11A) and in the supernatant (FIG. 11B) for various yeast strains. The tested strains included (i) a parent strain expressing no heterologous ABC transporter, (ii) a strain expressing a H. polymorpha YBT1 transporter (SEQ ID NO: 55), and (iii) a strain expressing a S. cerevisiae YOR1 transporter (SEQ ID NO: 32).
Figure 11B:
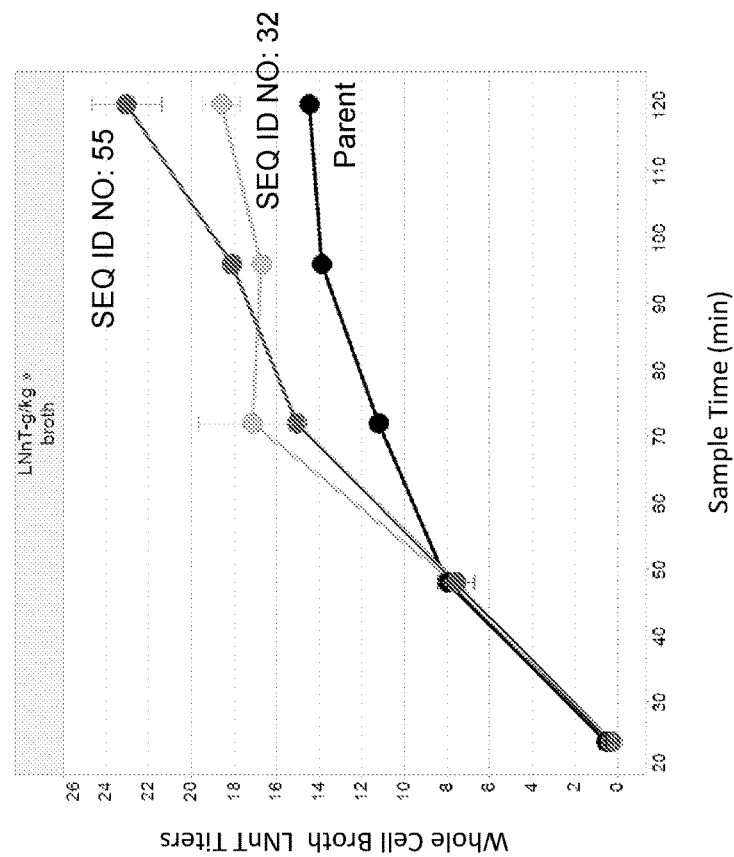

The concentration of whole cell broth lacto-N-neotetraose was measured for a strain expressing the Hp.YBT1 transporter (SEQ ID NO: 55), the Sc.YOR1 transporter (SEQ ID NO: 32), or no transporter (parent strain). In fermentation tanks, both the Sc.YOR1 (SEQ ID NO: 32) and the Hp.YBT1 (SEQ ID NO: 55) transporters improved whole cell broth titers of lacto-N-neotetraose by up to 40% over parent (FIG. 11A). The concentration of lacto-N-neotetraose in the supernatant was also measured to provide information as to the mode of transport, as this readout distinguishes lacto-N-neotetraose that is transported out of the cell from lacto-N-neotetraose that is transported into intracellular compartments. Sc.YOR1 (SEQ ID NO: 32) resulted in a concentration of lacto-N-neotetraose in the supernatant that was 3-5 times greater than the concentration of lacto-N-neotetraose in the supernatant of parent cells (FIG. 11B). The other transporter, Hp.YBT1 (SEQ ID NO: 55), resulted in less product in the supernatant, suggesting transport into an intracellular compartment. Cell density measurements, in combination with oxygen uptake rate, also show that addition of these transporters improves cell health, which, in turn, contributes to higher lacto-N-neotetraose titers.

Figure 12:
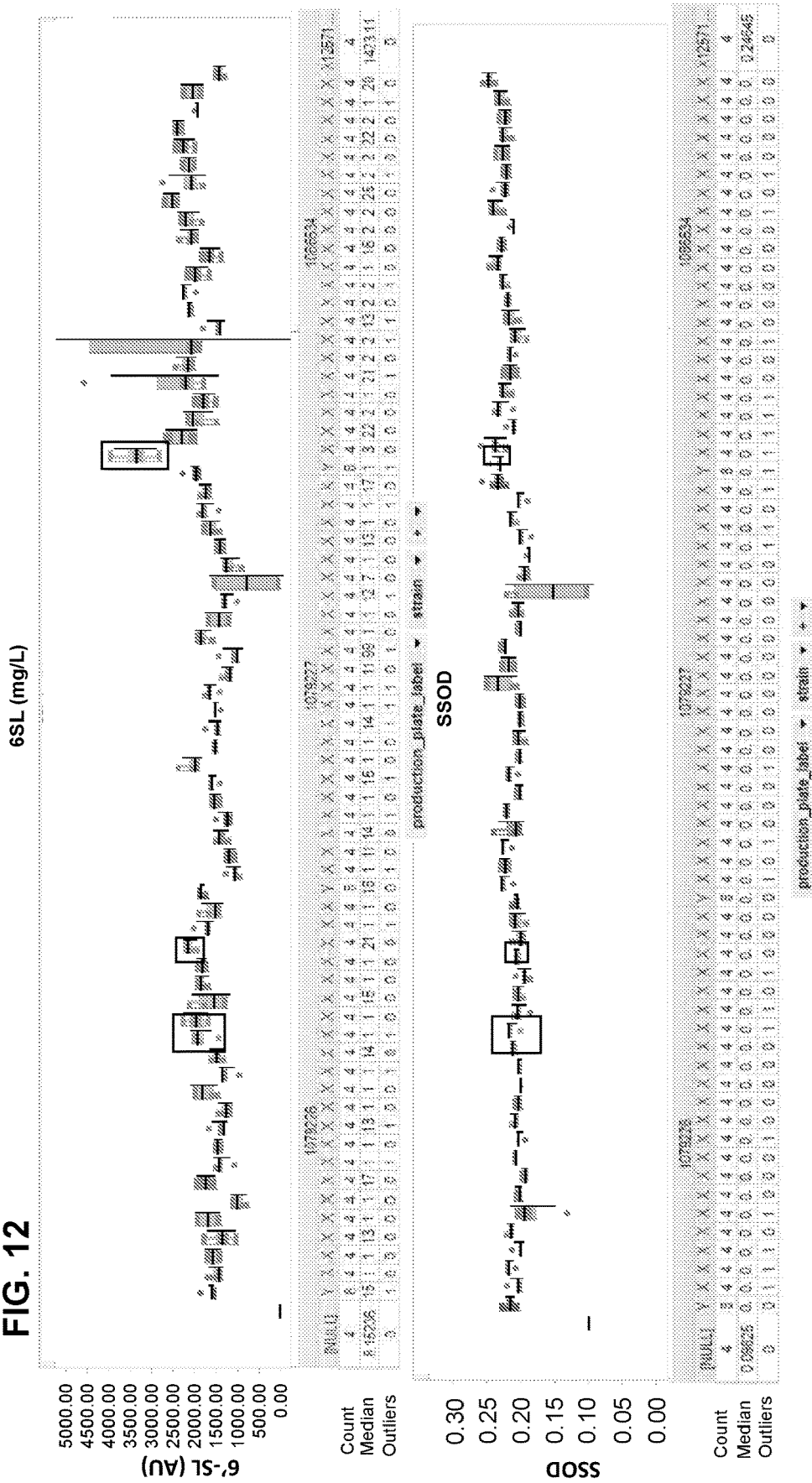
FIG. 12 provides data illustrating the amount of 6'-siallylactose (6'-SL) produced, as identified by mass spectrometry, as well as the cell growth (optical density, SSOD) in yeast strains with overexpression of ABC transporter polypeptides screened from a library of 309 transporters. Strains with ABC transporters that showed >25% titer improvement over the parent strain with no transporter are indicated in boxes.
Figure 13:
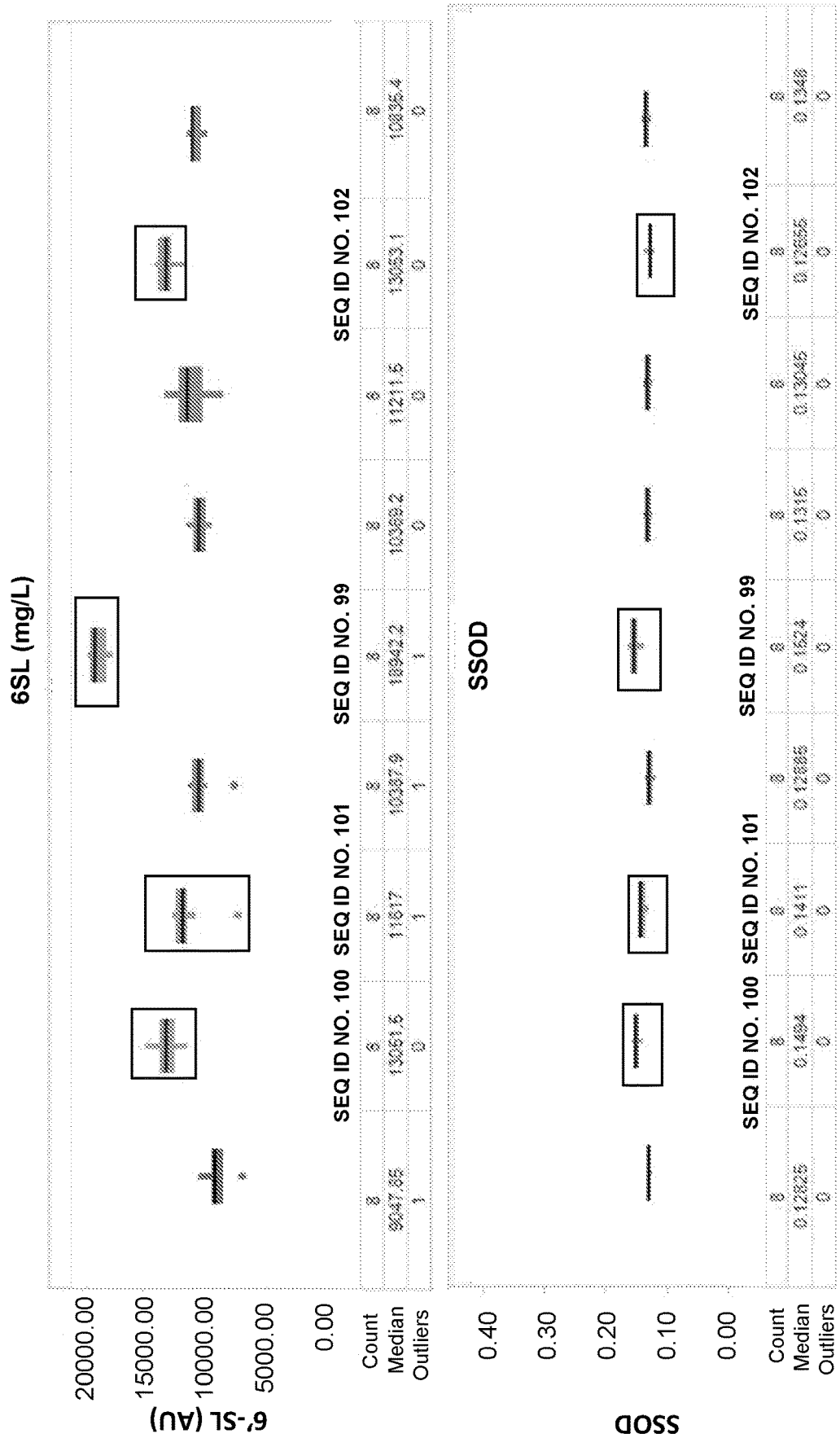
FIG. 13 provides data illustrating the amount of 6'-SL produced, as identified by mass spectrometry, and the cell growth (optical density, SSOD) in yeast strains overexpressing the highest performing transporters identified from a previous screen. Strains with ABC transporters that showed >25% titer improvement over the parent strain with no transporter are shown in boxes.

Example 3. 6' Sialyllactose Production in Strains Expressing Candidate Transporter Polypeptides DNA constructs encoding candidate 6'-sialyllactose exporter proteins from various fungi were amplified and introduced into a yeast strain genetically modified to produce 6'-SL. Transformants were assayed for increased 6'-SL production to identify putative 6'-SL transporters. Yeast strains were cultured for 3 days in 96-well plates then diluted into growth media containing a 4% sucrose/0.5% lactose minimal nutrient medium. Cultures were incubated for 3 days to sucrose exhaustion, the wells were extracted, and analyzed by mass spectrometry with quantification by comparison to known standards. 308 candidate exporters were assayed at low replication (n=1-4) for a >25% increase in 6'-SL titer under these growth conditions. A representative experiment is shown in FIG. 12. 29 strains (SEQ ID NOS: 99-126) that demonstrated >25% production of 6'-SL were re-assayed at high replication (n=8; FIG. 13). Of these 29 strains, 4 strains showed a >25% increase in 6'-SL. Introduction of genes encoding putative exporters in 6'-SL production strains did not cause significant impacts on growth.

Figure 14:
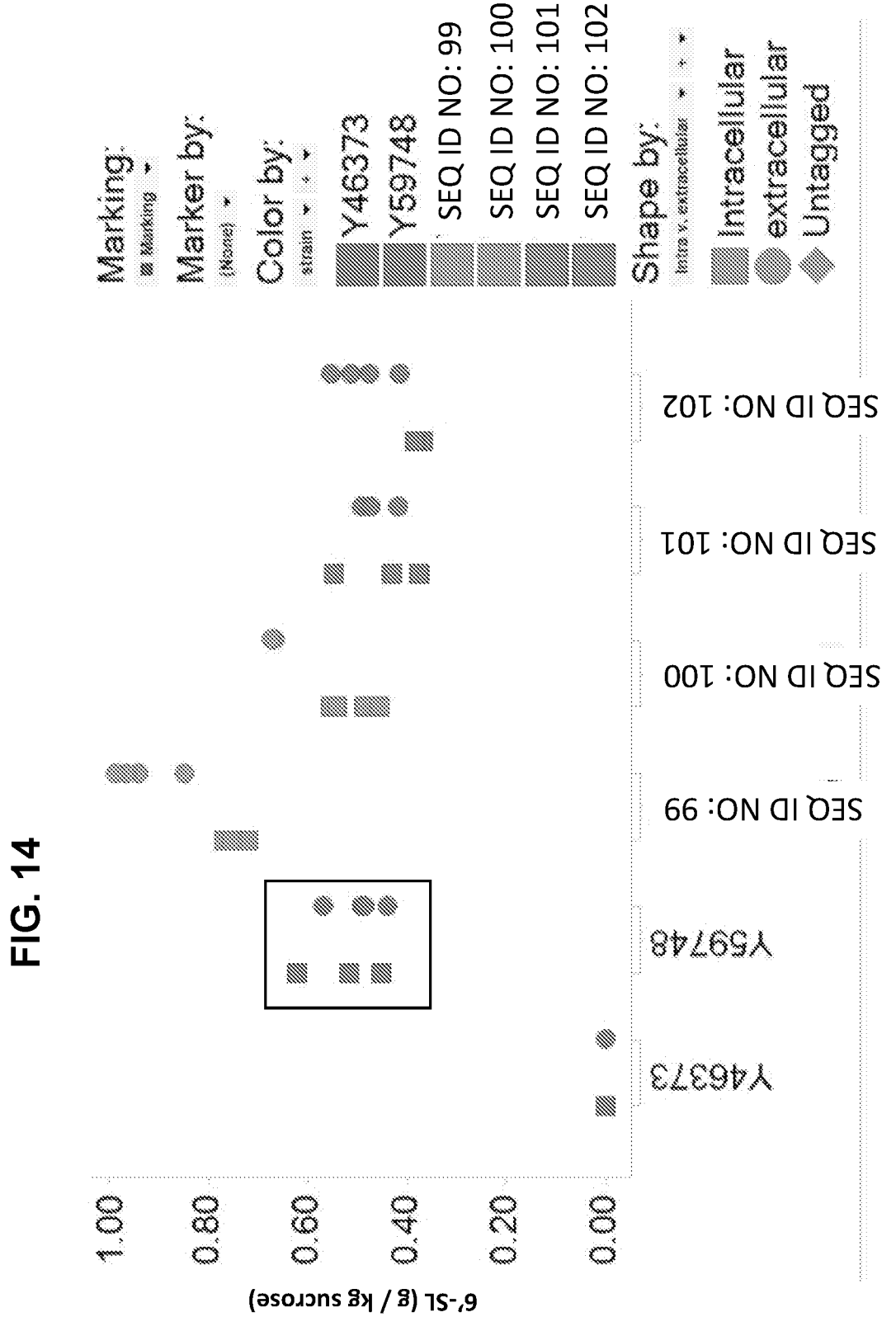
FIG. 14 is a graph showing the intracellular and extracellular amount of 6'-SL in (g/kg sucrose) for 4 strains that previously showed >25% production of 6'-SL in comparison to the parent strain with no transporter in a high-replication mass spectrometry assay. The control strain is shown in a box.

To demonstrate export of 6'-SL by putative transporters, 4 strains (SEQ ID NOS: 99-102) showing a >25% increase in 6'-SL production in a mass spectrometry assay at high replication were tested directly assayed for intracellular and extracellular 6'-SL concentration by fractionation and ion chromatography. Strains were cultured for 3 days in growth media in 96-well plates and diluted into a sucrose/lactose minimal nutrient medium for oligosaccharide production. Cultures were shaken for 3 days to sucrose exhaustion, then fractionated by centrifugation to separate supernatant and pellet fractions. Both supernatant and pellet fractions were subsequently extracted and analyzed by ion chromatography and quantitated by comparison to known standards. Two transporters, SEQ ID NOS: 99 and SEQ ID NO: 100 showed a statistically significant increase in 6'-SL titer in the extracellular fraction, suggesting these proteins are bonafide 6'-SL exporters (FIG. 14).

Illustrative Sequences

```
                        Illustrative Sequences

SEQ ID NO: 1 A0A0H5C1N2 encoded by gene BN1211_1957 from Cyberlindnera jadinii
ABC transporter polypeptide sequence
MSGERCSRFWDFDDLSPCAREELIGTQWPLVLLCASVATITVKGVYNYVHLGKRVSLR
DDGESEPLLTASQGAPLYTESSAEFTEDVKRSHFDSSSLPPVKLNGEPHGCKTLYKRSGV
EKVRVAVEELFVLAQLVLQSYRYQNTQSASSLANLLLWLWLLSSTTFRILNLNDKYEKI
QAIVPNLWVSNILIYFFLWFPAVLTFRSALLNHTGDDKLYYIVNFSVITLQIFNLATSKVG
YRCPQVYLSDQHRKPDDPEPFTDLLTLVTFSWVTPMMNQAFKVPLTQDDVWDLKMEDF
SYFVLKSFKKFSQGSTLGFSNRVILFFLPFLLVQAFWAVVESLILFAPTILLKRILEFVEDR
NTGNLPLAWFYVTLMFASKFFSNLSSGQALFFGRRVCIRLKSVVIGEIYAKALRRKLTTK
SSSTDQADAGLDKSPSPVSVNPTEEPEEQDKENETKSANLGAIINLMAVDAFKISEVCAY
LHAFFGATCMIIVSIYLLWKLMGWSALVGAFAIIALSPLNFMMSRKLGELQKKALAVTD
RRIQKLNETLQSIRIIKFFAWEKKFEEQILKIRDEELEMLKSRSVIWSFLVVLWCILPTIVT
VISFGCYIFIDKKVLTTPVAFTALSLFNLLRNPLDQISDMLSFAIQSKVSLDRVSEFLSQEE
TTKYEQLTHVKNTGRVGFSKASFSWDSTSDADFKLRDLDVDFTVGKLNVIIGPTGAGKT
SLLLALLGEMEITKGEVHLPGFLPREDLEIGPDGYTESVAYCSQAAWLLNDTIRNNIVFG
SPFNRDRYNKVVSACGLARDFEILKAGDQTEIGEKGIALSGGQKQRVSLARALYSNSRHI
LLDDCLSAVDSHTALHIYENCIAGPLMKNRTVLLVSHNVALTIKSADFVVVLNNGRITN
SGTPEQLLADGALGDDEMIKSTVYSRANSSVDLVQKSKQEEDAVLKVKEALNNMKPIE
NPEDEELENLKKGKLIEEEQKSEGVVSLEVYKWFFSIFGGWFIVAVLLGLFLVANVINFG
QSWWVRKWAKDASNDVHISIAGTLSESQYYGAMSQFIAKPLNVFVFKYHQIQNSMSVL
KETNISVYYIIVYGILGVSYALIVGLRIVYGFFMGIKASRRVFAKVLNKILRAKLRFFDSTP
IGRIMNRFSKDIESVDQDLIPPIDGAVSCAVSVLFTLAMIMAITPGFLIFAILILVMYYLVA
VPFYLSSSRELKRFDSITKSPIHQHFSETLVGASTIRAYGIERRFLQENLNKIDENNRPFFYM
WITNRWLSFRNDMIGASVIFLAGAFILFSLDKIDAGLAGISLSYAIVFNDTALWIVRLYAN
VEMAMNSVERLKEYTDVDEEPAEEVPENEPPESWPEHGALEVCDLSLRYAPHLPLVIKN
VSFNVEPSNKIGIVGRTGAGKSTIITALFRFLDPETGYIKIDGVDITSIGLKRLRQSITIIPQD
PTLFTGTIRSNLDPFGNYSDAFIFEALKRVNLITEDELANQGGSSSGSSSSDENANKFLNL
NSDVSEGGGNLSQGQRQLMCLARSLLRDPKIMLLDEATASIDYDSDAKIQQTIRQEFSNS
TILTIAHRLRSIIDYDKILVMDAGEVVEFDHPYKLISDKSTTFYSMCVDSGELDVLTQIAK
EAFKRTV SEQ ID NO: 2 W0T4J7_KLUMD Bile pigment transporter 1 Kluyveromyces marxianus
(strain DMKU3-1042 / BCC29191 / NBRC 104275) ABC transporter polypeptide sequence
MNRLIVETYHSNKIEDPTNLPLPPFDLDIPEATRIIQANWEYECWTERHSILLAVLKSVGG
RIAIAVSYEFLRTVLAILQPQILKKFIEAFNPESNELPRLNAYFVAVGLFILNVSCTVLRNQ
FFINIFQAGMKIRGSLMSMIYQKTFRLSAEARDEKGSGDIMNLMSVDVIRIQRFFENAQT
MIGAPTQLIGVLISLYFFLGTATLGGLVSIGIMIPLYSYLTEIYKRMFKAQMKYKDRRIKTI
SEILNSIKSIKLYAWEKPMLERLGHVRNDLELKNMKKIAIVSNLMSPIWDIVPVFVTSSTF
LLFSYLTGQVLTPQVVFPAMTLFGMLNQCVYTIPEMINNIIEIGVSLKRLKSYLLAEELDD
SFIERTEANDVDPTVEINNATFLWKSVKQSERSDANDDEEASVSSPGVALRDIEHFSAKR
AELTCIVGRVGSGKSTFLKAILGLLPCVPNDATPQIKPKLTIRAKSLAYCPQQPWIMNSSF
KDNILFGFKYDEAMYKKTIKACQLVPDLKILPDGDQTIVGEKGISLSGGQKARLSLARA
VYARADLYLLDDILSAVDSHVCKNIIEQVLDRNTGLLKNKTVILTTNAINVLQHSNMIYL
LKNGMIVEGNSYDSVMSTESANGEKSFLREIIEEYALNEKEKEEQEADTDAESKSKSPRN
DSDYLLSSDEDNEEEIIPLQPLVDLENAKATDANAVIAFEEEQEDPQLAKVVSRRASVAT
LKPRPLIDVNKDDRKTAQKAETKEEGRVKKSVYIAYMKACGFFGVLIVFILMIATKLLG
LGNNFWLKYWSESNQTNGGNDHIWKFMIVYSLIGMASAAFDVTRIIVMIFFCSLRAAKQ
LHNQMAHSVVMAPMSFFETTPVGRIVNRFSTDINSIDEDFKNIVALFLHSVFDYLITITVI
VISMPWFLLVNTFLLAIYYYQMFYVVLSRELKRLTSISYSPVMSLLGETLGGYVVINAY
NHADIFNYYHFQNVQTNVNFIFNFRSTNRWLSMRLETMGAFIILITSLMALGTLGTTHPIS
AGLIGLLMSYVLQISSSLMWIIRMLVNIETTIVSVERVLEYRDLEPEGVRVVEGNTPPKD
WPSKGEIKISNYTTKYRANLDPVLKDIDVNIKPQEKIGVVGRTGAGKSTLTLALFRILEPF
EGSISIDGIDISTLGLYDLRSRLAIIPQDAQAFEGTVRSNLDPFNYHTDAEVWRALELSHL
KPHIERIVKELGDDEEKPADLLQTKISDNGGNLSMGQRQLLCLSRALLNPSKILILDEATA
AVDRETDKIIQETIRSAFKDRTILTIAHRIDTVMDSDRILVLDKGELKEFDTPENLLENKES
LFYSLCEKGGYLKN SEQ ID NO: 3 A0A0H5C805_CYBJA Uncharacterized protein Cyberlindnera jadinii; ABC
transporter polypeptide sequence
MGDTLDSTDPAAERRSAHYKGLDAQVEGQIQELARALTPMSDVVSGSSSEESDSGSVLS
RALSTASTIAPGVNPMGDDLEELDPRLNPDNPDFSSRYWIKNIRAFMDKDEAHYQNYSF
GIAYKNLRASGEATDADYQTATLNAPLKFAGQYAKRFLSSKTAKRKSQFDILKHMDGL
VRPGEILVVLGRPGSGCTTLLKSIAANTHGFEIGEESQISYDGLSPHDIRKHFRGDIVYQA
ESDIHFPHLTVWQTLFTAARFRTPQNRIPGVTRDDYAAAMTNVYMATYGLLHTKNTKV
GSELVRGVSGGERKRVSIAEVSLAGAKLQCWDNATRGLDAATALEFIRALRTSADVLD
TTAIIAIYQCSQDAYDLFDKVSVLYDGYQIFFGRADEAKQYFLKMGWECPQRQTTADFL
TSVTSPRERIPRKGYEDKVPRTAKEFETYWKNSPEYTELIAEVDSALNGVDQSTQFYASK
HARQARHMRKSSPYTVSFPMQTKYLLAREFQRIRNNIGFHGFSLLANSLMALVLSSIFYN
LPSATSSFYYRGAAMFFALLVNGFSSFLEIMSLFEARPIIEKHKGYGLYHPSADALASVLS
QIPFKIFTALFFNLIYYFMVNFRREPGYFFFYLFVNILATFTMSHYFRLVGSMSSTLPQAV
VPGNIIMLTMILFTGFTIPINYMLGWCRWINYLDPMAYAFESLMVNEFYNRIFECSSYIPG
NPADNPSWPSDSWVCNVVGASAGETYVNGTLYLETSFRYSHGNKWRNVGILIAFMIAL
LAAYMLFSEYNESAKQKGEILLFQRSTLRKLKREKALNDIETGKERDITLEPEEEDVNVD
VIQAGKDIFHWRDVHYTIKIKSEYREILSGVDGWVKPGTLTALMGASGAGKTTLLDVLA
SRVTMGVVTGSMFVNGHLRDSSFQRSTGYVQQQDLHLETATVREALRFSAYMRQPSSV
PKQEKNEYVEEVIKILDMQKYADAVVGVAGEGLNVEQRKRLSIGVELAAKPKLLLFLD
EPTSGLDSQTAWSICQLMRKLANHGQAILCTIHQPSAILMQEFDRLLFLASGGRPVYFGD
```

-continued

| Illustrative Sequences |
| --- |

LGDHCQTLIDYFENHGSPKCPPDANPAEWMLHVIGAAPGSHANQDYHQVWLESDERKE
VLKELEYMEKELVKLPYDPTAEQEEFATSIPYQFVTVVKRTFQMYWRTPSYTWAKLFL
ASSSPLFIGFVFFNADLSLQGLQNQMFALFMILMIFNPTIQQQLPMFVRQRDLYEVRERPS
KTFSWTAFMAAQIAAEIPWSFVLGTISYFAFYYPAGFYHNAEPTNQVNQRGAYAWLYM
CLLFIFTSTFGNMCIAPLELADSAGNVVSLSFTLCLTFCGVLVGPDQLPGFWIFMYRVSPL
TYFIDGFLSNALGNAKVTCSQDELRVLNPPESNMTCSEYLGEYLESAGTGYLTDGSSTSD
CEMCPMSTTNDFLSTINCSYSRKWRNLGIFCAYIVINVVGAVLFYWLARVPKKKNRVKE
KSPFASSSSADSENKDVDSNLEKVTTQ

SEQ ID NO: 4 *Sclerotinia sclerotiorum* ABC transporter polypeptide sequence
MMKQGYKKYLTEDDLWNLAKRDTTKACSETFEESWEYEIEHKKNPSLWVAIFRSFSGP
YFRGALFKTVSDSLAFIQPQLLKLLIKWVKSRSSDEPQPVIRGAAIALAMFSVSVGQTMA
LHQYFQRAFETGMRIKTALTAAIYKKSLKLSNEGRASKSTGDIVNYMAVDTQRLQDLT
QYGQQLWSAPYQILLCMISLYQLVGLSMLAGVAAMILMIPINGLIARLMKKLQQEQMK
NKDSRTRLIAEIINNMKSIKLYAWSSAFMAKLNFVRNDQELKTLRKIGAAQSVANFTWS
TTPFLVSCSTFAVFVLTNDSPLTTDIVFPTLTLLNLLTFPLAILPMVITSIIEASVAVKRLTSF
FTAEELQPDAVILKGPIEDDGEESLTIRDASFSWDRNSDRHVLQDIHFSAHKGELTCIVGR
VGAGKSSFLQALLGDLWKVKGQVVVHGKTAYVAQQPWVMNASVKENILFGHRFDPTF
YDKTVKACALTDDFAQLPDGDETEVGERGISLSGGQKARLTLARAVYARADIYLLDDC
LSAVDQHVGRHLIDNVFGSTGLLSGKTRVLATNSIPVLKEANLICLIRDNKIIERGTYDQA
IARRGEIANLINTSENKDVSTDSETTEASDSSTILDYEQPGEEEAKDEAEEAQEHLTQLQPI
RPGGSGVKKRKGSSNTLRRASTASFRGPRGKLRDEEDPLKSKQGKEHSEQGKVKWDVY
AEYAKTSNLAAVLIYLAMLVGAQTAQISGSVWLKSWAEANDKLGINRDVGKYIGVYFA
FGIGSAALVVIQTLILWIFCSIEASRKLHERMAFAIFRSPMSFFETTPAGRILNRFSRYVVVI
SVSTPAFIALIIPLSGVYYWVQRYYLRTSRELKRLDSVSRSPIYAHFQESLGGIGTIRAYRQ
QQRFTQENEWRVDANLRAYFPSINSNRWLAVRLEFLGSLIILSAAGFAIVTVSAGGDLSS
GLVGLAMSYALQITQSLNWIVRQTVEVETNIVSVERVLEYARLPSEAPEVIHRHRPPISW
PASGGVNFNNYSTRYREGLDLVLKNINLDIKPHEKIGVVGRTGAGKSSLTLALFRIIEPSE
GNISIDALNTSTIGLLDLRRRLAIIPQDAALFEGTVRDNLDPGHVHDDTELWSVLEHARL
KDHVSTMNGGLEAKIQEGGSNLSQGQRQLVSLARALLTPSNILVLDEATAAVDVETDA
LLQTTLRSPLFAKRTIITIAHRINTILDSDRIVVLEQGQVKEFDSPKKLMEKRGLFWKLVR
EAGLEAM SEQ ID NO: 5 *Cyberlindnera jadinii* ABC transporter polypeptide sequence
MASPGSEKCTPRSDEDLERSEPQLQRRLLTPFLLSKKVPPIPKEDERKPYPYLKTNPLSQI
LFWWLNPLLRVGYKRTLDPNDFYYLEHSQDIETTYSNYEMHLARILEKDRAKAREKDP
TLTDEDLKNREYPKNAVIKALFLTFKWKYLWSIFLKLLSDIVLVLNPLLSKALINFVDEK
MYNPDMSVGRGVGYAIGVTFMLGTSGILINHFLYLSLTVGAHCKAVLTTAIMNKSFRAS
AKSKHEYPSGRVTSLMSTDLARIDLAIGFQPFAITVPVPIGVAIALLIVNIGVSALAGIAVF
LVCIVVISASSKSLLKMRKGANQYTDARISYMREILQNMRIIKFYSWEDAYEKSVVTERN
SEMSIILKMQSIRNFLLALSLSLPAIISMVAFLVLYGVSNDKNPGNIFSSISLFSVLAQQTM
MLPMALATGADAKIGLERLRQYLQSGDIEKEYEDHEKPGDRDVVLPDNVAVELNNASF
IWEKFDDADDNDGNSEKTKEVVVTSKSSLTDSSHIDKSTDSADGEYIKSVFEGFSDINLTI
KKGEFVIITGPIGSGKSSLLVALAGFMKKTTGTLGVNGTMLLCGQPWVQNCTVRDNILF
GLEYDKDRYDRVVEVCALGDDLKMFTAGDQTEIGERGITLSGGQKARINLARAVYANK
DIILLDDVLSAVDARVGKLIVDDCLTSFLGDKTRILATHQLSLIEAADRVIYLNGDGTIHI
GTVQELLESNEGFLKLMKFSKKSESEEEENVEAANEKDVSLQKAVSVVQEQDAHAGVL
IGQEERAVNGIEWDIYKEYLHEGRGKLGIFAIPTIIMLLVLDVFTSIFVNVWLSFWISHKF
KARSDGFYIGLYVMFVILSVIWITAEFVVMGYFSSTAARRLNLKAMKRVLHTPMHFLDV
TPMGRILNRFTKDTDVLDNEIGEQARMFLHPAAYVIGVLILCIIYIPWFAIAIPPLAILFTFI
TNFYIASSREVKRIEAIQRSLVYNNFNEVLNGLQTLKAYNATSRFMEKNKRLLNRMNEA
YLLVIANQRWISVNLDLVSCCFVFLISMLSVFRVFDINASSVGLVVTSVLQIGGLMSLIMR
AYTTVENEMNSVERLCHYANKLEQEAPYIMNETKPRPTWPEHGAIEFKHASMRYREGL
PLVLKDLTISVKGGEKIGICGRTGAGKSTIMNALYRLTELAEGSITIDDVEISQLGLYDLR
SKLAIIPQDPVLFRGTIRKNLDPFGQNDDETLWDALRRSGLVEGSILNTIKSQSKDDPNFH
KFHLDQTVEDEGANFSLGERQLIALARALVRNSKILILDEATSSVDYETDSKIQKTISTEF
SHCTILCIAHRLKTILTYDRILVLEKGEVEEFDTPRELYSKNGVFRQMCERSEINSADFV SEQ ID NO: 6 *Candida haemulonis* ABC transporter polypeptide sequence
MDQRRQKRLLTPFLSKKVPPVPYDDERIVYPKRPNIFSAIFFWWLHPVMSTGYKRTLDT
ADLYKLNDENEVEAMTARFEGIFERRLHDARQKHIAAKCKARGETIENSSVPAEEDLEG
YQPPKLLCAWAILETFKWQYGLACLYNTLANTAAVTNPLLSKKLIQFVERHAMGLDTQ
TGKGVGYALGASFMVLIIGILINHGFQNAMLTGAQVKGVLTKAFLDKSFRLSDRARHDY
PASKITSMMGTDLARIDFALGFQPFLVSFPIPIAVAIGILIWNIGAPALVGIGLVFLFLGFIM
VFTGKLFAYRKKANKYTDARVNYIKEVLNNLKIIKYYSWEEPYNDVIGENRAKEMNIIY
KMQVGRNVILSSAMCLTLFASMASFLVLYATSGSTKDPASLFSSISLFNSMAQQVIMLPL
ALATGSDAAVGIMRAAQFLAAEEVDANATAIYAPPETRDQMEKDGLSISIKNASFEWES
FDNSSDDDEDEVKPKNDLEITEKGEAKENQGQSDDKSSSSTNTMKESDAEPKLTTYSTG
SSTMEATIFTGLSNIDLSVQKGEFIVITGLIGSGKTSLLNALAGFMKRVAGHVDVNGSLLL
CENPWIQNTTVRENILFGEEFDQDTYDSVLYACSLESDLEILPAGDQTEIGERGINLSGGQ
KARINLARAVYANKDIVLLDDVLSAVDARVGKHIMNNCLLGLLKDKTRILATHQLSLIG
AADRVVFLNGDGTVDVGTLEDLRKTNAGFEHLMKFSSESADDDEEETSPEEALGEDPEI
EEREMIERQLSQKQSTIPDEEAERHDYNVNEKQDGRLMSQENRAVNRIKGVVYKRYIK
YGSGIFKYYTGVPIIITLTIVAVFCQLFTNTWLTFWSDFKFDGKDNGFYIGFYVMFTVLAF
IFLSSEFIIVAYMTNEAAKVLNLKAVSRVLRAPMSFMDTTPMGRILNRFTKDTDTLDNEI
GNQIRMLIYFLSNIIGVIVLCVIYLPWFAIAIPFLGAIFVSVGNFYQASAREIKRLEATQRSF
VYNNFNETLSGMNTIKAYKAQTRFRKKNSTFIDNMNEAYYLTIANQRWLAIHLDLIAML

| Illustrative Sequences |
|---|
| FAIIICFLCIFRVFDIGPAATGLLLSYVLQIAGQLSMLVRTYTQVENEMNAVERICEYAFH |
| LEQEAPYTYENSVLPPSWPEEGGIRFINASLAYREGLPNVLKSLNMDINPLEKIGICGRTG |
| AGKSSIMTALYRLAELNEGSIEIDGVDIGSIGLRDLRSKLSIIPQDPVLFRGSIRKNLDPFGA |
| SPDDVLWDAMRRAGLIEASKLSTIRNQSKSSENLFKFHLDREVEDNGSNFSLGERQLISF |
| ARALVRGSKILILDEATSSVDYETDSKIQETIKREFNDCTILCIAHRLKTIVNYDRILVLDK |
| GEIKEFDTPWNLFNSKHSIFQQMCEKSNITKEDFVARDR |
| |
| SEQ ID NO: 7 *Candida pseudohaemulonii* ABC transporter polypeptide sequence |
| MSVPVIPTTPIARKRLVNASFDNYNEEEDPTFVDEPTEVSDSEDLISVISNVLLSDDDSVE |
| TKGGNGDIKNLSTPAQKETWKEWAIRHEVPRKLLHLLIGPFSLWLYTLGATMNQILWPL |
| VFLTAVLFINDYVRLHNPEVNKVMTRVFGLILRQSEINGYNGTLFYALGVLLVFTSAPK |
| DIAVMAVLLLSWADTAALTVGRLWGKYTPKVMPGKSLAGCLASFATGVFLCYLFYGY |
| FCVAYAHVNKPGMIFWTEETSKMSLHVYAIATGLAASILEASDIGGIDDNFIIPVMSAILL |
| YVLKRLLTPFLSKKVPPIPYEDERIVYPKRPNFISAVFFWWLHPVMSTGYKRTLQTQDLY |
| RLNDENEVAAMTARFEGIFERRLSNSRRKHIAAKCKARGETPETSSVPAEEDLADHQPP |
| KMLCAWAILETFKWQYGLACLYNTLANTASVTNPLLSKRLIQFVEKHALGLDTQVGKG |
| VGYALGASFMVLLIGILINHGFQNAMLTGAQVKGVLTKAFLDKSFRLSDRARHDYPGS |
| KITSMMGTDLARIDFALGFQPFLVSFPVPTAVAIGILIWNIGAPALVGIGLVFVFLFAIMVL |
| TGKLFQYRKKANKYTDARINYIKEVLNNLKIIKFYSWEEPYNDVIGENRSKEMNIIYKM |
| QVGRNIILSLAMCLTLFASMASFLVLYATAGSTKDPASLFSSISLFNSLAQQVIMLPLALA |
| TGSDALVGIFRAAQFLSAEEVDANATAIYAPPDVQDEMDYQNLAISLKGACFEWETFDQ |
| NDDDEEENDEKNPESKKDSKNEKGTIEELQADNKLSLSTNTAKESEVEPKLTTYSTGDS |
| TMEATIFSGLSNINLDVQKNEFIVITGLIGSGKTSLLNALAGFMKRVSGSVDVNGSLLLCE |
| TPWIQNATVRENILFGEEFDQEKYDSILFACSLESDLEILPAGDKTEIGERGINLSGGQKA |
| RINLARAVYANRDIVLLDDVLSAVDARVGKHIMNNCILGLLKDKTRILATHQLSLIGAA |
| DRVVFLNGDGTVDIGTFDELKKSNPGFDHLMKFSSESAEEEEEETLPEEALGEDPEVEDR |
| EMIQRQLSQKQSTVPDEEAERHNYNVNEQQDGRLMSQEGRAVNRIKGVVYKNYVKYG |
| SGVFKLYSGVPIVITLTIFAIFCQLFTNTWLTFWSEPKFDGKDNGFYIGFYVMFTVLAFIFL |
| SSEFVIVAYMTNEAAKVLNLKAVSRVLRAPMSFMDTTPMGRILNRFTKDTDTLDNEIGN |
| QIRMLIYFLSNIVGVIILCVVYLPWFAIAIPFLGMIFVSVANFYQASAREIKRLEATQRSFV |
| YNNFNETLSGMNTIKAYNAQERFKKKNSTFIDNMNEAYYLTIANQRWLAIHLDIIAMLF |
| AIIICFLCIFRVFDIGAAATGLLLSYVLQIAGQLSMLVRTYTQVENEMNAVERICEYAFHL |
| EQEAPYTFENSNLPATWPEQGSISFVNASLAYRPGLPNVLKSLNMDIKPLEKIGICGRTG |
| AGKSSIMTALYRLSELNEGMIEIDGVDISKLGLRDLRSKLSIIPQDPVLFRGSIRKNLDPFG |
| ASPDDDLWDAMRRAGLIESSKLSTIKNQTKSSDNLFKFHLDREVEDNGSNFSLGERQLIS |
| FARALVRGSKILILDEATSSVDYETDSKIQETIQREFTDCTILCIAHRLKTIVNYDRILVLD |
| KGEIKEFDTPWNLFNLKHSIFQQMCEKSSITKDDFAHKG |
| |
| SEQ ID NO: 8 *Metschnikowia fructicola* ABC transporter polypeptide sequence |
| MSRKAGHVDIVGSLLLCGVPWIQNTTVKDNILFGNALDEKKYQDVIYACSLESDLEILP |
| AGDQTEIGERGITLSGGQKARINLARAVYANTDIILLDDVLSAVDARVGKHIVNSCLLGL |
| LGDRTRILATHQLSLIGDADRIVFLKDGTVEVGLMDDLKRRVPEFRELMAYNAETKD |
| DDEDEGSDSEDPDMEVKEFIAKQVTRQSTAVDEEAAHHDYGVNEDKDGRLIMDEAKA |
| VNAIQFGVIKDYVKYGSGVFKYYSIVPVIVVLTMLAVFCQLFTNTWLSFWTGLKFPGKS |
| NGFYIGFYVMFTVLAFVLVTVQFMVLAYLTIKASTTLNIMAVERVLRVPMSYMDTTPM |
| GRIINRFTKDTDTLDNEIGNQLRMVVYIFSNIVGVLILCVIYLPWFAIAIPALVAIFVAISNF |
| YQASGREIKRLEAVQRSLVYNNFNETLSGMDTIKAYRRENMFVDKNSTLINRMNESYYI |
| TIANQRWLAIHLDVVATILALVVSLLCVFRVFDISASSVGLLLSYVLQIAGQLSLLVRML |
| TQVENEFNSVERICEYAFKLPEEAPAFVSETKPHESWPSRGEIRFENASLAYRPGLPLVLK |
| NLNLDIKPTEKIGVCGRTGAGKSSIMAALYRLSELESGRIEIDGVDISQLGLHSLRSKLSIIP |
| QDPVLFKGTIRKNLDPFGDSSEADLWTALVRAGLIEQSKLAYIKAQDQSSDNLHKFPHLN |
| REVDDDGANFSLGERQLISFARALVRGSKILILDEATSSVDYETDSKIQSTIVREFQDCTIL |
| CIAHRLKTILNYDRILVLDKGEIKEFDTPWNLFNSSQSIFQQMCHKSNIVADDFVRKD |
| |
| SEQ ID NO: 9 *Wickerhamomyces ciferrii* ABC transporter polypeptide sequence |
| MSSLWSNIDLEKSNAHIQPSRPVKRLLTPILTKKIPPIPQESERTSYPFYRTNILSKAFCTW |
| LLPLLSKGYKRTLQQEDLWKLDEHTSIDYVYTNFEKHLNDEMSKFDSKHQDDEESFPRF |
| AIFLALVKTFKYEYSIAIITKFISNALNAFAPLISKRLINFISEKALYPDTPINKGVGYSIGLT |
| FMLMFSAIFMNQSLLHSKLVGGHSKTLLTKTLIQKSLVSNSETKFPHYPSGRIISFMSADLQ |
| RIDQSIYELPTGLTIIEPIIIAIILLLINIGVSALAGIAVFFLTLTVMAIPAISLFKIRKRANVFT |
| DERINKMREVIQSLKMIKFYSWEDAYEEMITNIRSKESSLVLKFQFIVNLVITIAINSSSITA |
| MGAFLVLYAVDSQGNPATVFSSLTLFGILSTQIIELPMVFSSAAEGLLGLSRVTKFLRSPE |
| ETFDLENYYNDELIKDEKTSILIENGNFEWPLFNEKSQDEKPNKKLKKSNSWFSKKKVET |
| TVEEVIESDDSTIGKESKNFKLSNINLKISKGEFIVITGPTGSGKSSLLSAISALMNKTHGEI |
| GINGSNLLCGSPWIQNTTIRENIIFGSKFDREKYDEILKVCSLKHDLQNLSAGDLTEIGER |
| GVTLSGGQKSRVNLARAIYADKDIYLFDDILSAVDANVGKHITENCLLGYIKDKTRIITT |
| HQLSLINKADRIVFLNGDGTVDIGTESELRSQNKEFVQLMVFNEDSRIEIENKDQIDYKT |
| QNQTEKNVTTSHEKPLESDGTLIKAEERAVDSIPLSLYKQYIHAGQGIFGYSAVPLTLIFVI |
| FAVFTKLFVNVWLSFWVSYKFKNLTNGEYIAIYVMITALSVIFVSIELSIMGYVFTESSKN |
| LNLKAMKKVLHSPMSFIDTTPVGRIINRFSKDTNSLDNEIGMQLKLFVYYSSSIIGILMCII |
| YLPWFAIAVPFLIIFFLCITNFYQASSREVKRLEAINRSFVYNNFNEVMNGMNTIKSYGAQ |
| SRFIAKNDLLNDHLNEVYFVVVANQRWIAVSLDIMATGIVLIVTMLSLTGQFNINASSVG |
| LLTYYMIELSRMLSTLMQTYSEVENDMNSVERVCQYANNLEQEAAYKKLDYQPRPTW |
| PEEGSIEFKDLSLKYRDDLPLVLKKLSISIKGGEKIGICGRTGAGKSSLMVALYRIAESFEG |
| QVLIDGIDISKLGLYDLRSKLSIIPQDPVLFQGTIRSNLDPFNNNTDEELWDALKRSGLAG |

-continued

| Illustrative Sequences |
| --- |

REDDKFHLESIVEDEGANFSLGERQLLALARALVRRTKILIMDEATSSVDYKTDSFVQET
ITREFSDCTILCIAHRLKTIINYDKILVLEKGELEEFDKPLELFQRQGVFRDMCIASNIGAD
DF

SEQ ID NO: 10 *Debaryomyces hansenii* ABC transporter polypeptide sequence
MLSNKVPPLPLDEERKQYPEKRVNLLSRIFFLWLLPVLNTGYKRTLKPEDMFKLTDDIRI
ETMYARFYKILEASLKKAKQKHIVQKCKERGETVETNSVDEEDDMSDFKLPKALTVIAV
LKTFKWQYLKSCFYLALANGGMTANPLQTKKLISYVEMKSLGYETGIGKGLGYSFGSA
GVVLVTGILINHFFYNSMLTGAEAKAVLTKAILDKSFRTNPETKHKYPAGKVTSMMGT
DLARIDFAIGFQPFLFTFPVPIAVAIGILIYNVGATALVGIGLLFVFMAAITVATKKLFEYR
SKANAYTDSRVDYIKEVLNNLRIIKFYSWEPPYHENISNIRREEMKIIYRMQVLRNIIVSF
AMSMNLFSSLVTFLVLYAINSNDRDPASIFSSISLFAILSQQVIMLPMALATGVDAFIGLQ
RVGAYLASGEVDMEANKIEATGEALALMEKSNTSIEIRNASFEWDTFEDEENSAESEHK
EITSHSSDSDSSKELTKSLSGSNSEEITFPGLREINLSIRKNEFVVITGLIGSGKSSLLSAMSG
FMRRSSGEINVNGSLLLCGYPWVQNETVRENILFGCEYDEEKYKNVIYACSLESDLEILP
AGDNTEIGERGITLSGGQKARINLARAVYADKDIVLLDDVLSAVDARVGKHIMNNCML
GLLKDKTRVLATHQLSLIGTADRIIFLNGDGTIEVGTLEELNANNPDFNKLMAFNGQTN
DSDDEEEEENEVIDDDEIVENEKELIQRQLSKTQTHKSAIQDDESTKRDYNKNNTNDGK
LFEEEEKAVNGISFDVYKNYVKHGSGIFKHFGIVPLLISSIILATFCQLFTNTWLSFWTEYR
FSSKPDRFYIGFYVMFTILAFLFLTLEFVLLAYLTNRASRSLNVIAVDKVLHAPMSFMDT
TPMGRILNRFTKDTDVLDNEIGDQLRLLFFMFSNIVGVFILCICYLPWFAIAVPFLVFIFVA
VANYYQSSAREIKRLEAVQRSHVYNNFNETLNGMNTIKAYKADNRFLDKNDRLINKMN
EAYYITIANQRWLAIHLDIIASLMALLVALLCVNRVFNISASSVGLLLSYVLQIAGQLSML
IRTFTQVENEMNSVERICNYAYNLPEEAPYFITENTPHPEWPRNGGIKFENASMAYRPGL
PLVLKDLNLDIKPTEKIGICGRTGAGKSSIMTALYRLSELESGKIMIDDVDISHLGLKDLR
SCLSIIPQDPILFRGTIRTNLDPFKEHSDETLWDALRRSGLIDDSRMKNIQKQEKENDVLH
KFHLDQGVEDEGSNFSLGERQLIAFARALVRDSKILILDEATSSVDYGTDSKVQTTIAREF
SNCTILCIAHRLKTILHYDRILVLDRGEVQEFDTPLNLFNMDNSIFQQMCQRSNIVLDDFQ
K SEQ ID NO: 11 *Lachancea mirantina* ABC transporter polypeptide sequence
MPTIRQELRHSSSGSENEKAESLYVKNEGKLDKVATQNSYYEVDRNRPETFMNSDDLE
KVTESEIYPQKRMFSFLHSKKIPPIPTDEERPVYPLFHANWISRIFFWWVFPILRVGYKRTL
QPGDLWKMDDRMSIETLYADFERYLEVYREKARVQYRKEHPNATEEEIIENAVMPKHT
LVKVLLYTFKWQYFLAFAAMALSNAASAFLPMVTKRLIDFVSEKSFYPGLKVNAGVGY
AIGSCVMMLLNGVLFNHFFHNSQLTGVQAKSVLIKAILTKSMKLSGFSRHRFPSGKITSI
MSTDLSRLELAIIFQPLLGAFFVAVAICIVLLIINLGPIALVGVGIFVVAMFFSAYAFKRLIS
VRKKTNIFTDARVTMMREILNSMKMIKFYAWEDAYEASVHDQRSKEISKTRIMQFTRNF
VTALAVCLTNISSMVTFLALYKVRNHGRTPANIFSSLSLFQVLSIQMFFLPMALGTAVDG
SIALNRCQELFEATEEEHDIDVDFPPCDDPDLALKVVNGSFEWQDFEAEENRLATLMEIE
EKKKKKTKSKKDKAPEPKHEAASIKPGHLSDTERESFKGFHNLNFEVKKGELIIITGSIGT
GKTSLLNALAGFMRKTEGDVYKNGSLLLCGYPWVQNATVRDNILFGSPYDKARYKEVI
RVCSLQADLDILPANDKTEIGERGITLSGGQKARINLARSVYKSMDTYLFDDVLSAVDA
RVGKHIMDECMLGRLGNKTRILATHQLSLIDRASRVIFLGTDGSFDFGSVTELKKRNAGF
NKLMEFANKSSDKEEGELDSTEASGDDVSTAEELEHFRDDDGQREMDASRLKKELSKR
SYESSVDENEAAGRLMAKEERAVNSIGFDVYKNYISAGVGKKGFVLLPFYVILLAVTTF
SLLFSSVWLSFWTEDKFKRQAGFYMGMYIFFVFFNYFCTTGQFTLLCYLGLTASKMLNL
KAVKRILHTPMSFIDTTPIGRILNRFTKDTDTLDTELTESVRLFVYQTANIIGVVIMCIIYLP
WFAIAVPFLVIIFALVANHYQSSSREIKRLEAIQRSHVFNNFNEVLGGIDTIRAYRGQERF
LMKNDFLTNKMNEAGYLVVAVQRWVSIALDMIAMAFALIIALLCVTRQFHISPSSVGVL
LTYVLQLPGLLNTLMRAMTQGENDMNSAERLIAYATDLPLEANYRKPEMTPAEPWPSH
GEIVFDDVSLAYRPGLPLVLKNVSIDIGSGEKIGICGRTGAGKSTIMTALYRICELHSGTV
SIDGVDISKIGLYDLRSKLSIIPQDPVLFKGSIRRNLDPFNERTDEQLWDALVRSGAVEAS
EIAEVKAQSPETSGAYANMHKFHLRQEVEDDGSNFSLGERQLLALTRALVRQSKILILDE
ATSSVDYETDAKIQAKIVQEFSSCTILCIAHRLNTILDYDRILVLEQGSVAEFDTPKALFR
AGGIFTEMCQRSGITSADFKEN SEQ ID NO: 12 *Puccinia graminisf*. sp. *tritici* ABC transporter polypeptide sequence
MNSKPQETPPSSSKISKPKLSYPRRFDRASKGAQLKHIAPSPAPPIVHSSMDQVELIPELK
ASILSILTFQWIQPLLSQGYRRPLVETDLWALDHDRQSDILSDKLLENYRKRQLAAQKDQ
PAGDPKHLAKASLVRALNDTFFRRFWIAGLCKLISDGFVACTPLVNRALIEYGNSVYRH
KLNPDTTPPPHSKAHGYGLAIGLFLMQASSTFFLHQFFYLSMSVGVLSRSALIAAIYKRSL
SFSSRSRKQFPTSQLVGHISSDVSRIDVCMGLFHMSWATPIQLAAILAILVLQIGPSSLAGV
GFILMLLPLQIAAMGLMFSLRMKVVSWTDKRTRKTQEVLQGVKLLKLFGWEEAFLSIID
RFRVKELNLLHKALVVLAASLALANSFPLLGSVIAFVTYSAMGHGAGNPEAVFTSLSLF
NLLGLPLLILPIALGSIADARSGIQRLEKVFEAEVVEEQDEIFVDSTLDASIRVTKSSWVW
EPNNADDGDQEKKPDNPIADLSIDDQKNPTHPNPANVTSSFRLTDIEMDIKRGSLTAIVG
PTASGKSSLIQALIGEMQQISGSPPSFGGQVSYCPQNAWIQNDTIRDNIIFGSEMDEKRYQ
AVIHAACLQADLDMLPQGDMTLIGEKGINLSGGQKQRINIARSIYFISDIILFDDPLSAVD
AHVAKHVFEHAIRGSNYTAGHSGIGNQTKILVTHALHLLPKVDEIICMNDGKIQERGTFE
ELLAAGGTFCALYRDFAGGQHQQNHAANQTPEKAETEISTKSPTEKDHNQSVDDRVDH
IPKNEPSGKIEGDDDLNQMQQEERVTGSVPWSVYKHLFTAGNGKWLGPLLVISVVFEQS
AVVLSSYWLVWWQNAKIQISQATYMGVYASLGIFQTLSGFAMGAVGVTIGFYASKNLH
HGALKAITRAPLAFFDTTPLGRIMNRLSKDVDSIDNKLNDSMRMVLTTLSQVIGAIILIGI
TSRYFLLAMAGVTAGCWLLATFYRPSARDIQRLNNLLRSKLYAQFTESLNGITTIKAYG
MKAKSIVKHCRLLDHETRAYYLTTVNQQWLGIRLEGFGSILVFIVAIISVAQAGSINPSQI
GLILTYVQTISQSLSWLVRQIAEVENSLNSVERVLWYQKNVPQEAAALLPDTDPDTTWP

| Illustrative Sequences |
| --- |
| SGGSIQFDSIVMSYRPGLPQVLKGLSIDVAAGEKIGVVGRTGAGKSSLMLALFRTTELES<br>GSIKIDGVNIREIGLDRLRRSISIIPQDAILFEGTIRTNLDPFDEYDDQSLWDALSRSGLNQK<br>NAYLGETKEKYGLDSVIEDEGVNLSVGERNLVSLARALVKNSKIIVLDEATASVDFETD<br>AKIQETIRKEFGDKTLLCIAHRLRTVINYDKIVVMDGGRAVEIGTPLALYDQETGIFRNM<br>CESSSITRQDIVSSRGSHSSVGDT<br><br>SEQ ID NO: 13 Cladosporium fulvum ABC transporter polypeptide sequence<br>MSAPDAERPWTANTDTPGPYDTNHADPLAEEPLERVTHEKDLSEEKVLDFEALEETSSN<br>SDSDLGKKHRRPEVESSQSNWTAGTETSVATSLAPDPEEESPRKRTWSQRLNPLKRKPPP<br>PVPKERLPSREHEAGWFSVYTFQWISPLMSVGYQRPLETNDIWAVNPDRSVEVMKARL<br>YTNLEKRRAQPGRINPLVMALYDTFKKEFWIGGITNLFGALLQVLSPFVMKYLIAFAGR<br>AYRAQLGQIPAPHVGEGIGLVLGITAMQICQSSCINHFIYRGMIVGGQCRSVLISVIFEKA<br>MILSGRAKAGGKAHASEEDLKPDFAPGSKEEKAWYKKQLGSGKKGVSGDGQGWGNG<br>RIVNLMSVDTYRIDQACGMGHMIWTSPIQILLTLALLCINLTYSALAGFAFICVMMPLLA<br>RAIRSLMARRKFINKITDQRVSLTQEIVSSVRFVKYFGWETSFLERLNEIRTREINKVSFLL<br>SIRNGIMAVSMSLPIFSSMLAFITYSTTQHVLNPAPVFSSLALFNALRIPLNLLPMVLGQV<br>VDANESITRISEFLAAEEANDDSNWDNDAENAISIEHAEFTWERNTKNESDGAPGQNPK<br>GEKQRKLEAKQAKKDAEAEAKEDKWRSKLIEKGELDALPTPSSTTSLAEEARPFRIRDID<br>LNVGRDELVAVIGSVGSGKSSFLAALAGDMRKTSGSVTFGANRRAFCPQSAWIQNATV<br>KDNITFGRDYNKKWYNDVVDACALRPDLDMLPAGDMTEIGERGITVSGGQKQRLNIAR<br>AIYFDADIIIMDDPLSAVDAHVGRHIMDNAICGLLKGKARVLATHQLHVLHRVDRIVW<br>MKDGAIHKIATFPQLMESDQEFQELMKTTAAEETKEDVEEVLEDEIEDEKTNAKKKKG<br>KKPAAALMQNEERAVKSVGWGVYVAYIKASGSIMIAPLILFLLISQGANIMTSLWLSY<br>WTSGRFGLSLGIYIGVYATLGVVQALLMFAFSVTLTVYGTRASKTMLDRAMYRVLRAP<br>MSFFDTTPMGRITNRFSKDVDTMDNTLTDSMRMFFLTMAMIVSVFILIIAYYYYFVIALIP<br>LTICFVLAAGYYRASARELKRHEAVLRSVVFSRFSEAVNGQATIRAYGVQKRFADNVDE<br>AVDSMDGAYFLTFANQRWLSTRLDVLGNLLVFTVGILVVTSRFTINPSTGGLVLSYILSI<br>VQMIQFTVRQLAEVENNMNSTERIHYYGTQLEEEAPLHLGDVRPTWPEKGGIDFDNVQ<br>MRYRDGLPLVLKGLTMKVRAGERIGIVGRTGAGKSTILSTLFRLVELSGGSITIDGVNIA<br>KIGLHDLRSRLAIIPQDPTLFRGTIRSNLDPPNEHTDLELWNALRQADLVGAEQTIEDEAG<br>RIHLDTPVEDEGLNFSLGQRQLLALARALVRGSQIIICDEATSSVDFETDQKIQKTIVRGF<br>QGKTLLCIAHRLKTIIGYDRILVMDQGNVAELDSPISLYDQGGIFRSMCDRSGIRRQDFFN<br>SEEARFGAESPALERTQSAMFQQPEQAYVKEG<br><br>SEQ ID NO: 14 Alternaria brassiccicola ABC transporter polypeptide sequence<br>MLKKKEKKQSPKTVAGVAGEGEGWGNGRIVNLMSTDTYRIDQASGFFHMIWTAPVGIL<br>ITTALLLVNLTYSALPGLGLILIAMPLLGRAVKTLFRRRVAINKITDQRVSLTQEILQGVR<br>FVKYFGWETSFLERIQTIRKKEIHGIQILLTIRNAVLSVGMSMPVFASMISFITYSQVNANL<br>DPAPIFSSLALFNSMRIPLNFLPLVIGQVIDANASVKRIQEFLLAEEAEESGTWDYNAKDA<br>VTLKGANFTWERHPTQDAEEGAGGPPGKKPTRQEKKENKANAKLAQTSGESAPSDATA<br>VEEEKPFEVKGLDLKIGRNELVAIIGGVGSGKSSLLAALAGDMRKTSGEVIFGASRAFCP<br>QYAWIQNATVRENIIFGKEFNRKWYDQVVDACALRPDLDMLPHNDATEIGERGITVSG<br>GQKQRMNIARAIYFNADIVLMDDPLSAVDAHVGRHIMDNAICGLLKDKCRILATHQLH<br>VLSRCDRIIWVDQGEVKAVDTFDNLMAQNADFVQVMSTTAKEDEKEEEEEEVDEDEV<br>EAEVKSTKKQRKQKKQAALMQQEERATKSVSWEVWIEYIKAGGGLWVGPLVFILLVLS<br>QGANIVTSLWLSYWTSDKFGYSEGAYIGAYAAFGFSQALFMFFFSFSVSIFGTRAGKVM<br>LHRAITRVLRAPMSFFDTTPLGRITNRFSKDIDVMDNTITDAMRMYFLTLAMIISVFILIIS<br>YYHYYAIALGPLFIFFMFSAAFYRSSAREVKRHEAVLRSTVFSRFGEAVMGTPTIRAYGL<br>QNQFSKSVRDAVDDMNSAYYLTFANQRWLSVRLDIVGILLVFTTGILVVTSRFSVDPSIA<br>GLVLSYILTIVQMIQFTVRQLAEVENNMNSTERIHHYGSQLEEEAPLHMGEVRPTWPEH<br>GEIVFDKVEMRYRDGLPLVLKGLSMHVRAGERIGVVGRTGAGKSSIMSALFRLQELSGG<br>SIVIDGVDIGKIGLHDLRSKLAIIPQDPTLFKGTVRSNLDPFHEHSDLELWSALRQADLVS<br>NEQSMDDHSGRIHLDSVVEEEGLNFSLGQRQLMALARALVRGSQIIVCDEATSSVDFET<br>DAKIQQTIVDGFKGKTLLCIAHRLKTIINYDRICVMDAGLIAELDSPLNLYDQGGIFKGM<br>CDRSGIKREEIAGAAK<br><br>SEQ ID NO: 15 Wickerhamomyces ciferrii ABC transporter polypeptide sequence<br>MVDVEQQTVYPEGYNKDDMILQKRLMTPLLSKKVPQIPNQDERKRYPYMHSNYISRIFF<br>WWIIPLLNIGYKRTLTSNDLYKLEDDMSINHTYPIFESHLNKIVAKSRSKALKKNPNLTEE<br>ELENIPYPKYSLVKALFLTFKVKYSLAIIFKALADIAQTLNPLLTKALINYVEERVYKPSTP<br>LGKGIGYAFGVAFVLLANGILINHFLHNSLTTGAHCKAILTTALLKKSFNADAKTRHTY<br>NAGKVTSLMGTDLARIDLAVGFQPPFAITFPLPVIIAIVLLIVNIGVSALAGIAIFIISIAIIGAS<br>AKRLLLMRKSANQYTDKRIGFMREILQSMKIIKFYSWEDAYQKNVTEQRNKEVSIIFKM<br>QTIRNFLMAYSVTLPTFTSMVAFLVLYGVKNDRNPANIFSSLSLFSALANQVLMLPMAL<br>ATGADAMIGIGRVREYLQCPDGKPLENNEDFDNNDGSQMINEKLAIKVKNASFEWEEFP<br>EVEEIKPIGKEKKGLRSRFQKKKKVDELDEKSNVILETSTSTDQSLKTNDQEINSDPETTA<br>AYTKNVFKGFHDINFEIKKGEFIIVTGPIGSGKSSLLTALSGFMKKTQGNLGINGSLLLCG<br>QSWVQNATVRENILFGLEFDEVRYRQVLKVCALTDDLKSFTGGELTEIGERGITLSGGQ<br>KARINLARAVYANKDVLLLDDVLSAVDARVGKHIMDNCLVDYLHGKTRILATHQLSLV<br>NDADRIIYLNGDGTINMGTVDELLATTPGFVTLMEYSKKSQDEENSEDDDDGKPEVIGE<br>ADVTLQATKSNTVSEKAGNAETGALIKAEEKAVNQTSWKVYLTYLKAGNGIFGIFASPL<br>AILSLVIEVFCGLFVNVWLSFWIEYKFKTRSDGFYIGIYVMFVFLYTGFSSCTFVLMGYIT<br>IPAAKVLNLRAMQKILHAPMSYIDTTPIGRIMNRFTKDTDALDNETGEQIRLFLHPTFSVG<br>GILIMCIIYLPWFAIAIPPLGVVFVCVTNYYQSSSREIKRLEAVKRSFVYNNFNEVGGMN<br>TIKAYNASDRFILKNSELLDNMNEAYFLVIANQRWISIHLDAVACVLSLIVSLLSVSRQFN<br>ISPASAGLVVTYTLNMAGLLSLILRAYTQVENEMNSVERLCHYANDLDQENAYRKPET<br>QPSSNWPEFGSLKFQNVSLRYRDGLPLVLKNLNVNIKGGEKIGICGRTGAGKSSIMTALY |

| | |
|---|---|
| | -continued |
| | Illustrative Sequences |

RLSELAEGDIIIDDINIKQLGLYELRSKLSIIPQDPVLFQGSIRKNLDPFDEHDEDKLWDAL
RRSGLIEDEQVLEVIKKQDKLDENFHKFHLNQQVEDEGANFSLGERQLLALARALVRDS
KILILDEATSSVDYETDAKIQTTIANEFKDCTILCIAHRLKTILGYDRILVLEQGEIEQFDEP
VTLFNEVDGIFRQMCDRSDIKSSDFLKDSYVYNSS

SEQ ID NO: 16 Komagataella phaffii ABC transporter polypeptide sequence
MSSLNSSSKEDDSASLEKQILPEMARQKRLFSFLLPSTIPPLPTDQERKPYPAGVQFSDIPY
HQWVPAFISRIFFWWVVPLLKTGYVRTIFPNDLYYLERSLKVEALADKFKKVYQKEVD
KRASPNEPMKLTTFMKPLFKTIGVYYFYAIGFKIIFDCGTTLAPLLTKELIKYVSLKSVGV
EPGIGKGVGYALGASFLIIVPGICLNHSLYYSTLCGQVLYSVLNKMVLEKSFRLDGVAEH
NYPIAKINSMLGTDLSRLELAFTFSPFMMTIPVTMAIAITLLIINIGVSALAGLGMFFLCLVI
VFSAIPLIIKIRIKIMGSTDKRVSHIKELANYLKFVKFYSWENSYFSSLTNARTTEMKYTFR
MHAIRNSLTALAVSTPALSSMLAFVVAHAVSRDRTPAEIFSSLSLFNVLSMIVFLLPMCLF
LSADALLGLKRVCNFLQAPEAHLYDEQETLKTDVALQAKNGTFYWETFENEDDTVAID
HKTTENNKAFSRLKNINLEVKKGEFLVITGLIGTGKSSLLAALSGQMKRESGSVSHQGSL
LLCGEPWIQNTTIRENIVFGQPFDETKYWEVIKCCALTQDLDMLDHGDITEVGERGITLS
GGQKARINLARAVYNDRDILLMDDVLSAVDARVGKHIMDNCIMGLLHDKTRILATHQL
SLISTADRICFLNGDGTIDVGTFEELSARNQNFTNLMVFNSESSESKDEEKELKLIKSTTLT
IEEKLPRFHDINDGKLMKKEQRAINGIPIDVYKTYISMGSGVFGKLFSPMFILVVAVTTFC
QLFTNVWLSFWTSNRFSHLSEGIYIGIYIMFTFLSMITVTTEYTLIAYLTNKASTKLNIAA
MKRFLHVPMSYLDTTPIGQIINRFTKDTDTLDNEIGEQFRMVVYPSANVIGVLIMCIAYLP
WFAIALPFLFLLFLLICSFYQATAREVKRIESIQRSFVFSHVNEVLNGMHTIKSYQREDSFI
SKNDLLLNNMNEASFITNVAQRWLAVILDTIGAGFAFLITMLCVTRQFDIGPSSVGLLVT
YLFQIVGQMSLLIRSITQLENNMNSVERLYEYSYNLPQEASYDSPSRPSPPSTWPENGVID
FKDVSLRYRPGLPLVLKNINIHIPSRFRVGICGRTGAGKSSIMTALYRINELAGGQIVIDDV
DISTLNLYDLRSNLSIIPQDPVLFKGTIRKNLDPFGEKEDDVLWAALLKSGIVESSSELEQ
VKLQKKKGQEELHKFHLDQVVEDEGSNFSLGERQLIALARAIVRDSKILILDEATSSVDY
KTDAKIQSAIVREFNKCSILCIAHRLKTIVNYDRILVLEAGQVAEFDTPWRLYHKSSGIFR
AMCEKANIMEHDFDNRS SEQ ID NO: 17 Issatchenkia orientialis ABC transporter polypeptide sequence
MSALNTDALESQPDFKFQRQKRLMSPFMSKKVPPIPTKEERKPYGEYHTNILFRIMFWW
LNPILNVGYKRTLTEQDLFYLDNSQTMDTLYETFKSHLKTTIEKSMKKYLQEKYSKEGK
TYDPSSIPTAEDLKDFQIPIYAIPLCLFKTLYWQYSLGNLYKVLSDCTSATTPLLQKKLINF
VQMKSFTALGSTGKGVGYAIGVCLMIFFQAITVNHAFHNLQICGAKSKAILTRMLLDKS
MSVDARGNHFFPASKVQSMISTDLNRVDLAIGFFPFALTCVFPIAICIGLLIWNVGVSALV
GIAIFVANVGLLAVSIPRLMRFRIKAMVFTDKRVTLMKELLKNFKMIKFYSWENSYARRI
QDARFKEMKLILSLQSLRNIVMSVSFAMPTLASMATFCTAFDITSGKNAASLFSSLSLFQ
VLSMQFMLAPVALNTAADMMVSMKKFNQFLAHADLDPEQYRIEEFHDDKLAVKVDN
ATFEWDTFDDDKVEDPALEFEKQDNDSLEKVSSHNTVDYDSTEKIRNDTSSIDSTKILEK
TAFPGLRNINLEIKKGEFVVVTGSIGAGKSSLLQAISGLMKRVSGKVYVDGDLLLCGYP
WVQNATIRDNILFGLPFDQEKYDQVVYACSLQSDFNQFQGGDMTEVGERGITLSGGQK
ARINLARSVYADKDIILLDDVLSAVDAKVGRHIVDTCLLGLLKDKTRIMATHQLSLIDSA
DRMIFLNGDGSIDCGTISELKDRNEKLNELLSHQKDKANDSDEELELQEEIESKEQHLKE
DLSEVKHEIKEEQKKMEISGDVGEEFEHADEHKEIVRIIGDEERAVNALKADVYINYAKL
AFGKLGLFSLMLFVTVAALQTYCMFTNTWLSFWIEEKFHGRSKSFYMGIYIMFAFLYTF
FLAAFFYSMCYFCNRASKYLNYKASEKILHVPMSFMDISPIGRVLNRFTKDTDVLDNEIL
DQFRQFLSPFCNAIGTIVLCIIYIPWFAIAVPLIVTFYVLVANYYQASAREIKRLEAVKRSL
VFGHFNEALSGKETIKAYRAIDRVKQRLNKLIDSGQNEAYFLTIVNQRWLGANLSILSFC
MVFIISFLCVFRVFNISAASTGLLLTYVINLTNTITMMMRAMTQVENEFNSVERLNHYAF
DLVQEAPYEIPENDPPQDWPKYGEIIFKDVSMRYRPELPFVLKNINLSIGKGEKIGFCGRT
GAGKSTFMTCLYRISEFEGTIVIDDVDISKLGLHKLRSKLTIIPQDPVLFVGSIRENLDPFG
EYSDEELWEALTISGLINKEDLNEVKKQNENDDNLNKFHLIRMVEDDGVNFSIGERQLIA
LARALVRKTKILILDEATSSVDYATDSRIQKTIATEFDDCMILCIAHRLNTILNYDKIVVM
DKGEIVEFDKPRSLFMREEGVFRSMCEQANITIEDFP SEQ ID NO: 18 Clavispora lusitaniae ABC transporter polypeptide sequence
MTVGSSPEPREPFSSDPFFSDPFSPQPFTSPQNTHDNYSREYSRATTPQSSSSNDSENTFVG
TPMKHNARDSSDEEASVGMPDLQVQKRMFTFLFSKKVPPVPLPEERREYPWKRARYAS
RMVFFWLWPVLIKGYKRTLVADDLWYLPTELTVEDMHRRYRENLDKILATRKDKEEE
WPVWAVPLALYKTFKFDYTLSCIFLAISFVCQALSPLITRRLIDFVQDRYFGLETTYNKGI
AYTIGAVVLIFINGLLLNHFFHKAMATGACVKLVLTKDVLVKSFALLAQLRRRFPAGQI
TSLMSTDLLRVDLAVGFQPLVVCFPIPVVIAVVLLLHNIGVTSLVGIGLFFVSLVACVLLT
SKLFFTREAVVEHTDERIGLMREVLAHLKVIKFYAWELAYKANITKVREREMRYLFTIK
VLRNFITAYAVTLPTLTSMVSFVTMWATGNMKQTGQVFLSLSLFSILAQAIMLLPIALAT
GADATIGFRRLREFLSAEEQGASGIEKPHAEWALQVEDADFQWGGGDGADEMDEKDE
ETKKWKRQTAEQTAEQTAERETPQVRRPAHVYRPDIARPAQNIRISVPRDDLADISTAEI
ATAQVARNIRNNRNNGNSTDNGNSTDNRDNKTKGFHLAHVTLAIPAGNFVVVTGAIGS
GKTTLLHALAGLMEKTHGKFAARETLLCGAPWIQNATVRQNILFGRPMDWARYHAVL
HACCLQQDLRELPGGDQCEIGERGVTLSGGQKARLSLARAAYRGAPVMLFDDVLSAVD
ARVGKHIATHLFHGLLQGCTRIVATHQLSLVRSADQVVFLGDRIEVGRPRELLARSAGF
RLLMAHDSTDTHTNGGLDGDDGLDTANSDFDDDTLGSDNLSNASLRRKSDQFSAIVAE
DVAVNAVSWDVYRQYIVLGAGVFGRLAVPVFLFVALATFCQLFTNTWLSFWMEGKF
RLLDRFYVAFYVLFAVLTVFVTGIQFTMLAYMNNRSAELLNVRAMEKVLHAPMSFMD
TNPMGRVLNRFTKDTDSVDNEIGEQLRLFIFPAATIVGIIILCICYLPYFAIAVPFLAGVFVF
LSDVYSGSAREIKRLEAVQRLVVYNNFNETLTGMATIQAYRAEQDFVAKNDRLLDRMN
EAYLLSIATQRWLCVHLDVIALMFALVICMLCITEQFNISASLTGLLLNYVIQIVGLLSLT

Illustrative Sequences

VRAMTQVETEMNSVERLHDYAFHMPQEAAYEKAESRPAPEWPMAGYINFRDVSLRYR
PQLPLVLKDLSFGVYPGEKVGICGRTGAGKSSLMTALYRLTELESGQITIDGVDIAHIGLR
DLRSQLLIIPQDPVLFQGTVRRNLDPFGEYSDSVLRDAMRRAGGVLEKFALDRAVDDDG
GNFSLGEKQLVALARALVRGLKILILDEATSSVDYATDARIQETIAREFSHCTILCIAHRL
KTILNYDRILVMDQGRVVEKGTPWALYQQKGVFSLMCHKAQIGEEDFGK

SEQ ID NO: 19 *Metschnikowia bicuspidata* ABC transporter polypeptide sequence
MTELQLQNRLLTPFLPKTVPPIPEENERPEYPTTLNPLSYLFFWWLHPVMRVGYKRTLEP
ADMFTLNEDIKVETLTRRFQGIFKRRLDTAQHQHVLAKIKQRSETSETSSVSFAEDVRDL
ELLKHFLTVALFLTFKWQYSLACIFLVLASVGLSTAPLLSKKLIEFVELRALGADVSIGSG
VGYALGSSFLVLVIGLLLNHTFQKSMLTGAQTNAVLVKAILDKSFRLNGQLRHDYPVSK
ITSIMSTDLARIDFALGFQPFLVSFPVAVGITIGILCDNIGAPAMRANKFTDSRVNYMKEV
LSNLKMIKFYSWEAPYFDRITENRTDEMHIIFNMQMVRNTIVSVATSLTLFASMASFLVV
YATLGSTQSPAEIFSSVSLFNSLTQQVFMLPLALSTAADAAVGIQRVAGFLAAEETDTLA
LETDVRPEMVEYMDRKKLAVKISNATFKWDSYQSAEPELTSSDSGTLHGDKLSKSGKH
VPLAALGKLDVSSSSSSEALEATIFDSLRNIDLEIRKGEFIAITGLIGTGKSSLLNAIAGFMS
RKDGAIDTVGSLLLCGAPWIQNTTVKENILFGSPLDEKRYQDVVYACSLESDLKILPAGD
QTEIGERGITLSGGQKARINLARAVYADKDIILMDDVLSAVDARVGKHIVNSCLMTLMA
EKTRILATHQLSLIGDADRIVFLKGDGTIEVGLLDDLQLRVAEFRELMAFNARAKDEEED
EENVPDGNAEKELIAKQLTRQSTAVDEEKVRHDYDANKHNDGRLIMDEARAVNAISFD
VVRNYIKYGSGVFKHYSIVPLLVLLTMISVFCQLFTNTWLSFWTELKFPGKSNGFYIGFY
VMFTILAFVFITIQFLLLTYMTIKASKVLHIKAVEQILRVPMSYMDTTPMGRIINRFTKDT
DTLDNEIGNQFRMVVNIFSTIVGVLILCVIYLPWFAIAIPALVAIFIVVSNFYQASAREVKR
LEAVQRSLVYNNFNETLGGMETIKAYKKETMFIDKNSTLINRMNESYYITIANQRWLAI
HLDFVATILVIVISLLCVFRVFDISASSVGLLLSYVLQIAGQLSLLVRMFTQLENEFNSVER
LSEYAFRLPQEAPALISETTPHESWPDTGMIRFENASLAYRPGLPLVLKSLNMDVKPREK
IGVCGRTGAGKSSIMAALYRLSELESGKIEIDGIDISQLGLHTLRSKLSIIPQDPVLFKGTIR
KNLDPFGESSEEELWTALTRAGLIESGKMALIKAQAQLSDNLHKFHLEREVHDGANFS
LGERQLISFARALVRGSKILILDEATSSVDYETDSKIQSTIVREFEDCTILCIAHRLKTILHY
DRILVLDKGEIKEFDTPWNLFTLKDSIFQQMCSKSNIVAEDFLERE SEQ ID NO: 20 *Clavispora lusitaniae* ABC transporter polypeptide sequence
MDHESAAFSLRAPPLRQNRLLSPLFSRKVPPVPQDHERHTYPLYGNPILWFFFTWLWPV
MITGYKRTLEPNDLYKLNDKLKADALAARFEAIFARRLAEDKRRHLEQAQDSSKILNSS
KNLLNSPDLADLADLADYVPSDTLCLWSLFETFKWQYLTACFLCALAQVGWTCNPLLS
KKLIAYVQRKALGIELDTGKGVGYALGVSLVVFCSDILFNQMYYLSSLTGAELKAIFTK
VMLDKSFRLNARSRRVYPASKITSIMSTDVSRIDLGLATAPMIIVAPVPLAISIGILIHNLK
APALLGIGIMILFLGFAGFLGSLLFKYRKLATTQTDARVSYMKEVLNNLKMIKFYSWEK
PYMAMIKAVREKEMTFLLKMQVTRSIIISVAVSLSLVASFASFMLLYGTASASKRNPASI
FSSVALFNILALVFINLPLAIAGATDAYIGMRRVGQYLASDEHVEDEKRVTSETDRQLME
EKNLAITVSNANFEWEIFDIPDEEKIKEEKKKQKDKEKNDKNKKKKLSLDESSHEAVT
KLEKPTSAATFKLRNIDLTIMKGEFVVVTGLIGSGKSSLLLALEGSMKRNSGQVKTNGSL
LMCGAPWIQSSTIRENVIFNNPYNKSWYEQVIDVCCMDSDLEILPAGDQTEIGERGITLS
GGQKARLSLARAVYARSDIILLDDVLSAVDAKVGKRIVDECILGVLRKKTVVLATHQLS
LIESADKIVFLNGDGTVDVGTSESLRRSNEAFQKLLSHSTTEKYAEEESSISSQTDESIKKV
VVEAQISRLTSVSSTNEKTDLQKQNEGKLIMEEEKSVNAIDADVYVRYIFAGIPGVKGA
MIFAAVIIFSILSVFFNLFTSTWLSFWVEYKWRNRSDGFYIGFYAAFTVLALVTLAFGFLG
VIYVMNLSSRTLNIRAAERILYVPMSYMNVTPMGRIINRFTKDTDVLDNEMGDRMGMII
YPASIIGGVLILCIIYLPWFAIAVPFLIVVFFGFANFYQASGREIKRLEAVQRSLVYNNFNE
TLTGLDTIRGYDKTDVFLSKNIRLIDKMNEAYFITVANQRWLDVAVSFLATIFAIIISFLCV
FRVFKINASSVGLLLSNTLQISGIITTLVVVYTRVEQDMNSAERIIEYVDDLPQEAPYIISET
TPNSAWPQEGQIDFNHVNLAYRPGLPMVLKDFTVHIDPNEKIGICGRTGAGKSSIMVAL
YRMVELTSGNITIDGIDIRTLGLNNLRSKLSIIPQDPVLFQGTIRKNLDPFGLATDEQLWET
LRRARIIKSEDLDEVKSQMDPSKMHKFHLDRDVDVDGENFSLGEKQLIAFARALVRGSK
ILILDEATSSVDYATDKILQEAIVEEFSDCTILCIAHRLKTILNYDRVMVMDQGQVVEFDK
PINLFKKQGTFFQMCEKAGINEKEFGH SEQ ID NO: 21 *Candida intermedia* ABC transporter polypeptide sequence
MSEKPARHILTPLLLKKVPPIPTDDERRVYPKKMNPFSWIFFWWINPIMMAGYKRKLAP
EDLYKLNDDIQVKTMTDNFSMHFQKQVAKAEQKHLAAKLKARGESSVNLSKSLTEDLE
DPFKVPKLIVIWTLMHTFGYQYFKACFLMMSLVAQTCNPLLSKELIKFVQLKAMGLDPH
MGKGVGYAIGTSFLVVTSGILINHAFSSMLTGAQVKGVLTKAMLDKSFRLSDGSKHKF
PTSKITSMMGTDLARIDFALGFQPFLFTFPIPIAISIGILCHNIGASAMVGVLVFTYLISVM
ILTGKLFKFRRSANKYTDTRVNYIKEVLNNLKMIKFYSWETPYSKMIGENRSKEMHIVY
LMQVGRNLITSGAMVLTLFASMAAFLTLYAVSNNTKSPAALFSSVSLFNSLAQQVFMLP
LALASGSDAIVGVIRAGEFLAAEEVDKAATTIDASPEMKEEMDKRNLALKVDHASPFKW
ETFESDKTSLKEEALDEKHPNDNSEDGSNLEKTAAELELESKLERKMTNYSSTSTTLDAT
IFSGLEDINIEVQKGEFLVITGVIGSGKTSLLNALSGFMKRTAGSVSINGSLLLCETPWIQN
ATVKENILFGLPLDEKRYKEVIYSCSLESDLEILPAGDQTEIGERGITLSGGQKARINLAR
AVYAGKDIILLDDVLSAVDARVGKHIMNNCIMGLLKDKTRILATHQLSLIGSANRVIFLN
GDGTIDVGSLQSKETNEAFQHLMAFNSEAKEKEEDVEEETDANEVAETERELIERQLT
RQSTKVSKAVTEADEEAMRYEYNTNEEKDGHLMSKERAAENSIAFSVYKRYVKYGSGI
FKHYSILPLVVILTAVSVFCQLFTNTWLSFWSEQKFHGKSNGFYIGFYVMFTILALVFLST
EFVILAYMCNKSATNLNLKAVEKILRVPMAYMDTTPMGRILNRFTKDTDTLDNEIGNQ
VRMVIFFFSNIVGIIILCIIYLPWFAIAVPFLAFVFVAIANFYQSSGREIKRLEATQRSFVYN
NFNETMSGMDTIKAYKAQDRFITINENNIDNMNEAYYITVANQRWLAIHLDVATAFAL
LICLLCVFRVFQISPASVGLLLSNVLLIAGQLSLLVRTFTQLENEMNSVERICEYAFDLPEE

| Illustrative Sequences |
|---|
| APYIIPETTPRELWPEQGSIRFENVSLAYRPGLPLVLKNLNLDVGSTEKIGICGRTGAGKS
SIMTALYRLSELDRGKIEIDGIDIGTIGLHNLRSKLSIIPQDPVLFRGTIRKNLDPFGESSDE
RLWDSLRRAGLIEESKLSIVRQQNEDSENFHKFHLNREVEDEGSNFSLGERQLIAFARAL
VRGSKVLILDEATSSVDYETDSKIQATIAREFKDCTILCIAHRLRTILNYDRILVLDKGEIK
QFDTPWNLFNSRDGIFRQMCERSNITREDFQ SEQ ID NO: 22 *Cyberlindnera jadinii* ABC transporter polypeptide sequence
MTSPGSEKCTPRSDEDLERSEPQLQRRLLTPFLLSKKVPPIPKEDERKPYPYLKTNPLSQIL
FWWLNPLLRVGYKRTLDPNDFYYLEHSQDIETTYSNYEMHLARILEKDRAKARAKDPT
LTDEDLKNREYPKNAVIKALFLTFKWKYLWSIFLKLLSDIVLVLNPLLSKALINFVDEKM
YNPDMSVGRGVGYAIGVTFMLGTSGILINHFLYLSLTVGAHCKAVLTTAIMNKSFRASA
KSKHEYPSGRVTSLMSTDLARIDLAIGFQPFAITVPVPIGVAIALLIVNIGVSALAGIAVFL
VCIVVISASSKSLLKMRKGANQYTDARISYMREILQNMRIIKFYSWEDAYEKSVVTERNS
EMSIILKMQSIRNFLLALSLSLPAIISMVAFLVLYGVSNDKNPGNIFSSISLFSVLAQQTMM
LPMALATGADAKIGLERLRQYLQSGDIEKEYEDHEKPGDRDVVLPDNVAVELNNASFI
WEKFDDADDNDGNSEKTKEVVVTSKSSLTDSSHDKSTDSADGEYIKSVFEGFNNINLTI
KKGEFVIITGPIGSGKSSLLVALAGFMKKTSGTLGVNGTMLLCGQPWVQNCTVRDNILF
GLEYDEARYDRVVEVCALGDDLKMFTAGDQTEIGERGITLSGGQKARINLARAVYANK
DIILLDDVLSAVDARVGKLIVDDCLTSFLGDKTRILATHQLSLIEAADRVIYLNGDGTIHI
GTVQELLESNEGFLKLMEFSRKSESEEEEDVEAANEKDVSLGKAVSVVQEQDAHAGVLI
GQEERAVNGIEWDIYKEYLHEGRGKLGIFAIPTIIMLLVLDVFTSIFVNVWLSFWISHKFK
ARSDGFYIGLYVMFVILSVIWITAEFVVMGYFSSTAARRLNLKAMKRVLHTPMHFLDVT
PMGRILNRFTKDTDVLDNEIGEQARMFLHPAAYVIGVLILCIIYIPWFAIAIPPLAILFTFIT
NFYIASSREVKRIEAIQRSLVYNNFNEVLNGLQTLKAYNATSRFMEKNKRLLNRMNEAY
LLVIANQRWISVNLDLVSCCFVFLISMLSVFRVFDINASSVGLVVTSVLQIGGLMSLIMRA
YTTVENEMNSVERLCHYANKLEQEAPYIMNETKPRPTWPEHGAIEFKHASMRYREGLP
LVLKDLTISVKGGEKIGICGRTGAGKSTIMNALYRLTELAEGSITIDGVEISQLGLYDLRS
KLAIIPQDPVLFRGTIRKNLDPFGQNDDETLWDALRRSGLVEGSILNTIKSQSKDDPNFHK
FHLDQTVEDEGANFSLGERQLIALARALVRNSKILILDEATSSVDYETDSKIQKTISTEFS
HCTILCIAHRLKTILTYDRILVLEKGEVEEFDTPRVLYSKNGVFRQMCERSEITSADFV SEQ ID NO: 23 *Xylaria hypoxylon* ABC transporter polypeptide sequence
MANETGEKGAKEADPITEANAPVKPESSTPYDDRDDHDDPEEEIRRREESLDERANREE
LKRTQSYATDTSTITRTTTRTSVPAASKKPWYKTPNPLLWGSVPPVPKEKQESREASGF
FSRLTFQWMAPLMNVGYKRPLEEGDLWKVNPKRSVDIMASKCSEAFERRIKKGDKYPL
LWAIHETFLWEFWVGGLCQLMASIFQVLSPFVLRFLIAFAQEAWDNKKSGQAPPPIGRGI
GLVVGVVFMQIFQSLGTNHFIFRGMMIGGQVRAVLISLIFEKSMLISGRAKAGGKAVAN
GTTEEKIDDSKDDDQEESSKKNSKAKKLGIAGDGVGWSNGRVVNLMSVDTYRLDQSSA
LFHIVWTAPIQCIITLVVLLINLSYSALAGFAILVIGIPALTRAIRSLFRRRGLINKITDQRVT
LTQEILQSVRFVKYFGWEEAFVKRLGEVRDREIHGIQVLLAIRNAINSVSLSLPIYASFLSF
ITYSLTDHGLGPAEVFSSLALFNGLRLPLNLLPLVIGNIIDAWSSMKRIQDFMLSENQEDT
AVFSPENKSAVEIKHASFTWERTPTQGDDKAAAAGKKGAPKKGTKQPTNNDNGAETSE
SNSDTASTLIDEREPFKLEDLNLAIGRKEIIAVIGSVGSGKSSLLAALAGDMRKTSGEVVL
GASRAFCPQYAWIQNASVRKNILFGKNMNREWYKEVIKACALQPDIDMLPDGDATEIG
ERGITVSGGQKQRLNIARAIYFDADIVLMDDPLSAVDAHVGRHIMDHAILGLLKDKCRIL
ATHQLWVLNRCDRIVWMDGGKIRAVDTFDKLMENEPGFRHLMETTAVEEKKDEDEVV
DEEKSDKDKKKKKAQGLMQAEERAVASVPWSVYARYVRASGSIFNALWVLLALVI
AQGGNIATSLWLSYWTADRFGYSQAVYIGVYAAIGTAQAIFLFIFAIMLTIFGTRASKTL
LRQAVTRTLRAPMSFFDTTPLGRITNRFSRDVDVMDNNLTDAMRMYFLTMVTVISVFA
LIIAFFYYFAIALVPLTIIFVLAASYYRASAREVKRFESVLRSVVFAKFSEGISGVASIRAY
GLQGRLVEDLRNAIDDMNSAYFLTFSNQRWLSVRLDLVGNLLVFTTGILVVTSRFSVPP
SIGGLVLSYILSIVQMLQFSVRQLAEVENGMNAVERLLHYGTQLEEEAPEHTVDVRPSW
PENGEIVFENVEMRYRENLPLVLKGLSMHVKGGERIGIVGRTGAGKSSIMSTLFRLVEIS
GGHITIDGIDIATIGLHDLRSRLAIIPQDPTLFRGTVRSNLDPFSEHSDLELWSALRQADLV
SVDAGPNDKDPGRIHLDSVVEEEGLNFSLGQRQLMALARALVRGSRIIVCDEATSSVDM
ETDDKIQKTMAVGFKGRTLLCIAHRLRTIIGYDRICVLDAGRITELGTPLELWEIEGGIFR
GMCERSGIRHEDLAAATANMGSLGEAPMPASLALEDGANEKAGSL SEQ ID NO: 24 *Naumovozyma castellii* ABC transporter polypeptide sequence
MPPPKKANRSSVISSSSLSSSSGDRSITDNSKLDDMIAGETINISPQDPFKDTPELDVTSAT
SGTISKMVSDDISSMMDSSLLPTGEYKLDRNKPETYLNSDDIEKVTQSDIFPQKRLFSFLH
SKKIPEVPSSDDERKEYPLFHANILSQLFIWWVIPIIKTGYKRTVQPNDLFKMDKRMSIET
LHDAFQKNMDYYFKKAEQKYLKSHPNATNEELAKHMKLPKWTVLKAIVFTFKRQLFV
ATVFAILANCTSGFNPMITKRLIEFVEKKTFFHDMTVNAGIGYAIGACIMMFLNGVFFNH
FFHLSQLTGVQAKSVLTKAALNKMFRASNYAKHQFPNGKVTSFVTTDLSRLEFAISFQP
FLFGFPAVFAICIVLLIVNLGAISLVGIGVFPSAFFACLFIFKQILGLRVVANKFTDARVTL
MREILNNMKMVKYYAWEDAYEKNIQDVRGKEINTVRKMLFIRNFVIAMATALPSVASL
VTFLCMYKVNNMGRTPGNVFSSLSLFQVLSIQMFFLPIAISTGIDMVIGLGRLQSLLESPE
DDPDLQLERLPAPDLNPNVALKMEDGAFEWENYELLDAQEKAEAEEKLKKEIEDYNQK
WYHFKKKTMPNPEELAKESTNAIDKTAELKLKKDLMEDKDAIEKIPFNGFHDLNFEIKK
GEFIIMVGPIGTGKTSLLNAFAGFMKNVSGRIQINGDLLLCGYPWIQNASVKDNIIFGSPY
NKAKYDEVIRVCSLKSDLDILPAGDLTEIGERGITLSGGQKARINLARSVYKQKDIYLFD
DVLSAVDSRVGKHIMDECFLGLLKDKTRILATHQLSLLERASRVIVLGNDGSFDIGTVEE
LKQRSSTLVNLLQFSSQTAEKEEDEENENQEEEMEKLEKQMTEISKVLSRKEAVDGHTT
MKEERAVNSISLKIYKEYLKAGVGKWGIVVVPCYLILIMCTTFCSLFSSVWLSYTEDK
FKNRAPSFYMGLYSFFVFFSYILTTSQFTLLCCIGVLSSKWLNLRAVKRILHTPMSYLDTT
PLGRILNRFTKDTDSLDNELTESVRMLLYQFANIVGVCIMCIIYLPWFAIAIPFLFVGFVLI |

| Illustrative Sequences |
|---|
| ADHYQSSGREIKRLEAIQRSFVYNNFNEVLGGMDTIKSYRSENRFIAKSDFLIDKMNEAG
YLVVAVQRWVAIFLDVIAVCFALIITLLCVTRAFPISAASVGVLLTYVLQLPGLLNGVLR
SLTQTENDMNSAERLVTYATELPLEADYRKPEVSPPEEWPTKGEIHFENVDFSYRPGLPT
VLKNLSLDIKSGEKIGICGRTGAGKSTIMSALYRLNEISSGKMIIDDVDISTIGLYDLRRKL
AIIPQDPVLFRGTIRKNLDPFNEHQDEHLWNALVRGGAIEQKELNEIKAQKPDEKGNHSE
MYKFHLDQLVEEEGANFSLGERQLLALTRALVRQARILILDEATSSVDYETDGKIQARIV
EEFGHCTILCIAHRLKTILTYDRILVLEKGEVAEFDTPKTLFAQEDSIFRSMCQRSGITEED
FI SEQ ID NO: 25 *Debaryomyces fabryi* ABC transporter polypeptide sequence
MSHIYSSNASIDGEGPVNSPPYDSYLNKYNNTNLLQVTTNNSETTTFVDNSITSRLAEN
NKKSPNATPGNENNNSSSNLNLEGQEILHNEKRLFSFLFSKKVPPVTAPEERTIYPWKKA
NVFSRMMFYWLWPVLYKGYKRTLLPDDLWYLTEELKVESMHERFDVNLNKRLEKDK
QKYLKKHNNLDGHVWSPYNIPLALFDTFKLQYSMSCIFLGLSFVCQALSPLITRRLIDFV
QNSYETRIFGVEVSYNEGIGYTIGAVVLIFVNGLLLNHFFHNAMVTGAQAKAILTKSLLL
KSFSLSSKSRNQFSIGKITSLMSTDLARIDLAIGFQPLVVCFPIPVIIAVVLLLKFIGVTSLAG
IGLFVVSLVLCVLLTKKLFTTREEVVLYTDERISLMREVLTNLKIIKFYAWEMAYKVGIT
KVRTKEMKYLFTIKVLRNFVTAYAVTLPTLTSMVSFTSMWANNSMKGAGKVFSSLSLF
SILAQAIMLLPIALATGADALIGFRRCRDYLVAEEYDDDLEERLASDVDKRYIAGDTNSE
FEFKHESFDLSETGSYENTNKNANVIEVSHANFIWESFYTENSSSWDLNSSGSLSEKDPK
QKKKSKSKDIKYQIKEKDSFQESSRSSNETYCESPSVIEARNFPGLTDINLSVKQGEFIIITG
SIGSGKSSLLAALSGFMKLENPSVGKVSIYDDLLLCSDPWIQNATVRDNIIFGKPYDETRY
NKVIRACCLEDDIKLLPARDLAEIGERGITLSGGQKSRINLARAAYADAGILLFDDVLSA
VDARVGKHIVNNLFNGLLKDKTKVLATHQLSLIESADKVVYLNGDGSIDFGTLNELLAR
NNQFKRLIEFNTDLTRDNESRKSETQRVYENYSDTDYDNNNGYEGARLIRQQSVVPESS
DIAGKIMGDEERATNAISWDIYKKYIDLGSGFFGWSAGPVFIFLISLATFCQLFTNTWLSF
WTEKKFPNKSDHFYVALYVMFAFLTVFFTAIEFTMLAYMNNRSAKLLNVKAVEKILHA
PMSYLDTNPMGRILNRFTKDTDSLDNEIGEQLRLFLFPLATIIGIVLICICYLPWFAIAVPFL
SFAFVFVANFYQGSSREIKRLEAVQRSLVYNNFNETLSGMSTIKAYKVEETFIEKNDRYL
NKMNEAYYVSIANQRWLGVHLDIIASIFALIICLLCITDQPHISASSTGLLLSYVIQIVGLLS
LTIRSMTQVENEMNSVERLHQYAFHLPQEGAYKKPESKPPAEWPPSGYIQFNNVSLKYR
DHLPTVLKNLNFSVYPGEKVGICGRTGAGKSSIMASALYRLVELNEGSIIIDGLNIAEMGL
YDLRSKLSIIPQDPVLFQGTIRRNLDPFNESTDEKLWDALRRSGLIDASQISKIKNTKLDQ
NRNIGHDSLHKFHLDQLVADDGSNFSLGERQLIALARAMVRNSKILILDEATSSVDYETD
AKIQETIVNEFSHCTILCIAHRLKTILHYDRILVMDKGSLIEKGTPYNLFTDRNGVFRQMC
DKTNIIDEDFQ SEQ ID NO: 26 *Saccharomyces cerevisiae* ABC transporter polypeptide sequence
MTITVGDAVSETELENKSQNVVLSPKASASSDISTDVDKDTSSSWDDKSLLPTGEYIVDR
NKPQTYLNSDDIEKVTESDIFPQKRLFSFLHSKKIPEVPQTDDERKIYPLFHTNIISNMFFW
WVLPILRVGYKRTIQPNDLFKMDPRMSIETLYDDFEKNMIYYFEKTRKKYRKRHPEATE
EEVMENAKLPKHTVLRALLFTFKKQYFMSIVFAILANCTSGFNPMITKRLIEFVEEKAIFH
SMHVNKGIGYAIGACLMMFVNGLTFNHFFHTSQLTGVQAKSILTKAAMKKMFNASNY
ARHCFPNGKVTSFVTTDLARIEFALSFQPFLAGFPAILAICIVLLIVNLGPIALVGIGIFFGG
FFISLFAFKLILGFRIAANIFTDARVTMMREVLNNIKMIKYYTWEDAYEKNIQDIRTKEIS
KVRKMQLSRNFLIAMAMSLPSIASLVTFLAMYKVNKGGRQPGNIFASLSLFQVLSLQMF
FLPIAIGTGIDMIIGLGRLQSLLEAPEDDPNQMIEMKPSPGFDPKLALKMTHCSFEWEDYE
LNDAIEEAKGEAKDEGKKNKKRKDTWGKPSASTNKAKRLDNMLKDRDGPEDLEKTS
FRGFKDLNFDIKKGEFIMITGPIGTGKSSLLNAMAGSMRKTDGKVEVNGDLLMCGYPWI
QNASVRDNIIFGSPFNKEKYDEVVRVCSLKADLDILPAGDMTEIGERGITLSGGQKARIN
LARSVYKKKDIYLFDDVLSAVDSRVGKHIMDECLTGMLANKTRILATHQLSLIERASRVI
VLGTDGQVDIGTVDELKARNQTLINLLQFSSQNSEKEDEEQEAVVAGELGQLKYESEVK
ELTELKKKATEMSQTANSGKIVADGHTSSKEERAVNSISLKIYREYIKAAVGKWGFIALP
LYAILVVGTTFCSLFSSVWLSYWTENKFKNRPPSFYMGLYSFFVFAAFIFMNGQFTILCA
MGIMASKWLNLRAVKRILHTPMSYIDTTPLGRILNRFTKDTDSLDNELTESLRLMTSQFA
NIVGVCVMCIVYLPWFAIAIPFLLVIFVLIADHYQSSGREIKRLEAVQRSFVYNNLNEVLG
GMDTIKAYRSQERFLAKSDFLINKMNEAGYLVVVLQRWVGIFLDMVAIAFALIITLLCV
TRAFPISAASVGVLLTYVLQLPGLLNTILRAMTQTENDMNSAERLVTYATELPLEASYR
KPEMTPPESWPSMGEIIFENVDFAYRPGLPIVLKNLNLNIKSGEKIGICGRTGAGKSTIMS
ALYRLNELTAGKILIDNVDISQLGLFDLRRKLAIIPQDPVLFRGTIRKNLDPFNERTDDEL
WDALVRGGAIAKDDLPEVKLQKPDENGTHGKMHKFHLDQAVEEEGSNFSLGERQLLA
LTRALVRQSKILILDEATSSVDYETDGKIQTRIVEEFGDCTILCIAHRLKTIVNYDRILVLE
KGEVAEFDTPWTLFSQEDSIFRSMCSRSGIVENDFENRS SEQ ID NO: 27 *Saccharomyces cerevisiae* ABC transporter polypeptide sequence
MPEAKLNNNVNDVTSYSSASSSTENAADLHNYNGFDEHTEARIQKLARTLTAQSMQNS
TQSAPNKSDAQSIFSSGVEGVNPIFSDPEAPGYDPKLDPNSENFSSAAWVKNMAHLSAA
DPDFYKPYSLGCAWKNLSASGASADVAYQSTVVNIPYKILKSGLRKFQRSKETNTFQIL
KPMDGCLNPGELLVVLGRPGSGCTTLLKSISSNTHGFDLGADTKISYSGYSGDDIKKHFR
GEVVYNAEADVHLPHLTVFETLVTVARLKTPQNRIKGVDRESYANHLAEVAMATYGLS
HTRNTKVGNDIVRGVSGGERKRVSIAEVSICGSKFQCWDNATRGLDSATALEFIRALKT
QADISNTSATVAIYQCSQDAYDLFNKVCVLDDGYQIYYGPADKAKKYFEDMGYVCPSR
QTTADFLTSVTSPSERTLNKDMLKKGIHIPQTPKEMNDYWVKSPNYKELMKEVDQRLL
NDDEASREAIKEAHIAKQSKRARPSSPYTVSYMMQVKYLLIRNMWRLRNNIGFTLFMIL
GNCSMALILGSMFFKIMKKGDTSTFYFRGSAMFFAILFNAFSSLLEIFSLYEARPITEKHR
TYSLYHPSADAFASVLSEIPSKLIIAVCFNIIFYFLVDFRRNGGVFFFYLLINIVAVFSMSHL
FRCVGSLTKTLSEAMVPASMLLLALSMYTGFAIPKKKILRWSKWIWYINPLAYLFESLLI |

| Illustrative Sequences |
|---|
| NEFHGIKFPCAEYVPRGPAYANISSTESVCTVVGAVPGQDYVLGDDFIRGTYQYYHKDK
WRGFGIGMAYVVFFFFVYLFLCEYNEGAKQKGEILVFPRSIVKRMKKRGVLTEKNAND
PENVGERSDLSSDRKMLQESSEEESDTYGEIGLSKSEAIFHWRNLCYEVQIKAETRRILN
NVDGWVKPGTLTALMGASGAGKTTLLDCLAERVTMGVITGDILVNGIPRDKSFPRSIGY
CQQQDLHLKTATVRESLRFSAYLRQPAEVSIEEKNRYVEEVIKILEMEKYADAVVGVAG
EGLNVEQRKRLTIGVELTAKPKLLVFLDEPTSGLDSQTAWSICQLMKKLANHGQAILCTI
HQPSAILMQEFDRLLFMQRGGKTVYFGDLGEGCKTMIDYFESHGAHKCPADANPAEW
MLEVVGAAPGSHANQDYYEVWRNSEEYRAVQSELDWMERELPKKGSITAAEDKHEFS
QSIIYQTKLVSIRLFQQYWRSPDYLWSKFILTIFNQLFIGFTFFKAGTSLQGLQNQMLAVF
MFTVIFNPILQQYLPSFVQQRDLYEARERPSRTFSWISFIFAQIFVEVPWNILAGTIAYFIY
YYPIGFYSNASAAGQLHERGALFWLFSCAFYVYVGSMGLLVISFNQVAESAANLASLLF
TMSLSFCGVMTTPSAMPRFWIFMYRVSPLTYFIQALLAVGVANVDVKCADYELLEFTPP
SGMTCGQYMEPYLQLAKTGYLTDENATDTCSFCQISTTNDYLANVNSFYSERWRNYGI
FICYIAFNYIAGVFFYWLARVPKKNGKLSKK SEQ ID NO: 28 *Kluyveromyces marxianus* ABC transporter polypeptide sequence
MAVSSSESTSSYSDVVHLQKETIPDTEIEILPDDLHSSSTGRRRTGSGAGSLKSASHVKEN
SVQIRNMYEIDKSKPETYLNHDDLEKVTESKIYEQKRLFRWFHSRKVPPIPETLEERPVYP
FRRANVISQLFFIWILPIVSVGYKRTLQPNDLWRMDDKMSIETLYERFDSHMKEFIEKAR
LEYRKEHPEATDQEVLKNAKLPKAALLKCLFYTFRYQYVTAFIFVLISNAASALTPLLTK
KLIAFVEKKSRFHDTKINSGVGYAIGSVLLMMINGIAFNHFFHLSALTGAEAKSLLIKTIL
HKSMKLSAYSKHKFSNGKITSLMSTDVSRLELAITFHPFLYAFPMVFVIALVLLLINIGVI
CLVGFAIFFAITFINFGAFKKILQFRLAATSITDKRVAMMREILNSIKMIKFYAWEDAYEE
NVKKVRAIESRLVKMMQLVRNTLVSLTMAFPNLASMVTFLAMYKVNKGGRSPANIFSS
LSLFQIMMIQMFFIPMSISTGIDAYVGLGRVQELLEAEEESDRYIENEEDLVLDDDTVFKV
KNASFEWENFEFEEAKELAKEKGESMSFSDRSVDTEKEDPGAEKTRFNGFHDLNFEIKE
NEFIIITGAIGTGKSSLLNAMAGFMSRTGSGMAVNGDLLLCGYPWVQNATVRDNITFGSP
FDQEKYEKVLEICSLEADLDILPAGDNTEVGERGITLSGGQKARITLARAVYKDMDIYLF
DDVLSAVDSRVCQHIVEHCMMGYLKDKTRILATHQLSLIGQASRVIFLGTDGSFDIGTVE
ELLSRNKGFHKLMQFQNSKPVGDEHSTNDENVFSEEDEESILKKQKSLTVGKKEEDGR
IIEKEERAVNALSFKVYKEYVSSGLGKYALMMIPIFLFIVASATFCNLFSSVWLSFWTEN
KFKHRTTGFYMGLYVMFVLLGIIFMWIEFVSVGTMAVNASKWLNLKALHRLLHAPMG
FMDVTPIGRVLNRFTKDTDALDNEISESLRLFIYQTANLTGIIILCIIYMPWFAIAMPFMIF
AYVFIADHYQASGREIKRMDAIQRSFVFNNFNEVLGGIDTIKAYRSQERFLMKSDFLINK
MNEAGYLVASIQRWVSITLDLLAVVFALIIALLCVTRQFHISPGSVGVLLTYVLQLPGLL
NGLLRSQTQTENDLNSAERLVNYAYDLPMEAQYRKLETQPNESWPSEGRIKFEHVSLSY
RPELPLVLKDVSIDIKGSEKIGICGRTGAGKSTIMSALYRLTELRSGKITIDDIDISTLGLYD
LRKKLAIIPQDDVLFKGDIRKNLDPFQECTDEQLWDALVRGGAIEKSELETVKLQKKDSH
GLSGNMHKFHLDQSVEENGSNFSLGERQLLALTRALVRGSKILILDEATSSVDYETDAKI
QSRIVEEFSRCTILCIAHRLKTILNYDRILVLDQGEVEFDKPETLFNDHSTIFYQMCCGA
GITAEDFSS SEQ ID NO: 29 *Vanderwaltozyma polyspora* ABC transporter polypeptide sequence
MLIGHTSSDSSSAGGDNNGAGNLRNADYDEKDYDKNGLSFQRSVNLSTLNSKSDASTDI
SYRFLPSGEYKVEANKPKTFLNQDDLEKVTDSEIYPQKRLFSFLHSKKIPPVPQDDDERKI
FPLYHANIISRIFIWWVFPIIKVGYKRTIQPNDLFITDKKMSIDAIYKSFEKNMNFYFEKYR
NEYKKLHPDATDQEVVENTELPRFTVLRALFFTFKYQYLWAVTCAILSNCASGLNPLLT
KRLIEFVEAKALVPSLHVNKGIGYAFGACIMIFVNGVFFNHFFCASQLTGSQAKSVLTKA
ALSKMFRANGYAKHKFPNGKVTSFVTTDLARIEFAISFQPFLAGFPAALAICIVLLIVNLG
PIALVGIGVFFASFFFSLFVFKQIIGLRVTSLIFTDARVTMMREILNNMKMVKYYAWEDA
YEKNITDIRTNEIDKVRKMQFIRNFMIALAMSLPNIASLVTFLAMYKVNSSGRTPGNIFAS
LSLFQILSLQMFFFPIAISTGIDMILGLDRFQNLLEAPEINQKLLDEMAPTSDIDPNTALRM
KNASFEWPDYEKIDAEQEAKQKDKNKNKKDKVKKKEESKKPSAKESSPVDLEKFAFSG
FKDINLEIHKGEFIMITGPIGTGKTSLLNAMSGLMEKTEGSVQINGELLMGGYPWIQNAT
VRDNIIFGSPFDKSKYNMVVKACCLDADLDILPAGDMTEIGERGINLSGGQKARINLARC
VYKNKDIYLFDDVLSAVDSRVGKLIMDECLLGLLNGKTRVLATHQLSLVENASRVIVLG
NDGSVDIGTVEELKKRNQTFITLMEHTTQKQDEDEEQDEEFEIEVKELSELEKNLTKVTT
KSEVDGHIINKEERAVNSIGWYIYKSYLKAAVGKWGFLVIPLYVFCVTATTFCSLFSSVW
LSFWTEDKFPTRSTSFYMGLYSFFVFGGYIFMTSQFTIVCFIGVNASKKLNLSAVRRILHT
PMAFLDTTPLGRILNRFTKDTDSLDNELTENVRLMLAQFANIIGVCMCIIYLPWFAIAIP
FILLIFVLVSNHYQSAGREIKRLEAIQRSFVYNNLNEVLGGMDTIRFYNSEERFMAKSDY
LIDKMNEAGYLVVCVQRWVAVLLDMIAVCFALIIALLCVTRQFHISASSVGVLLTYVLQ
LPGLLNTVLRALTQTENDMNSVERLVSYATELPTEAAYRKPESSPDPSWPQEGKIDFEEV
SFAYRPGLPAVLKNLSMSINGGEKIGICGRTGAGKSTIMSALYRLNELESGRIIIDGVNISN
IGLFDLRRSLSIIPQDVLFRGTIRKNLDPFGERSDDELWDALSRGGSIDKESLEEVKTQKS
TGNSKVQELHKFHLDQEVEEEGSNFSLGERQLLALARALVRNSKVLILDEATSSVDYET
DNKIQNRIIEAFSECTILCIAHRLKTILNYDRILVLEKGEIAEFDSPYNLYKMDGIFTSMCM
RSGITEEDFKLK SEQ ID NO: 30 *Nakaseomyces bacilisporus* ABC transporter polypeptide sequence
MYDRTDQTKADSTTSTESDEKYIVNEDHDDKNLSSNYYEQLSVSIANELQDSQGLTPTG
EYIVDKNKPVTYLNSNDIEKVTDSELFPQKRLFSFLHTKHIPAVPLDDSERTLYPMYHTN
LLSQLFIWWVFPIIRLGYKRTVQPNDLFKMDPRISIEKLHADFEHNMDYYFEKARRKLLK
ENPNATADDINNIKLPNHTVLRALFWTFKYQYLWSVWCAVLANCSSGFNPMITKRLIRF
VEEKAFFPNKKVNAGIGYAFGACIMMFVNGVFFNHFFHSSQLTGVQAKSVLIKATMKK
MFRANAYTKHKYPNGKVTSFVTTDLSRLEFALAFQPFLAGFPAIIAICIVLLIVNLGPISLV
GIGLFFASFVIALILFKQILKYRLAANVFTDARVTLMREVLSNMKMMKFYAWEDAYEE |

Illustrative Sequences

NIKDVRAKEIKRVRKMQFVRNFLFALAISLPNIASLVTFLCLHKIDHLGTSNPSNVFSSLS
LFQVLSLQMFFLPIALGTGVDMILGLTRLQGLLESPEEQSNHTLEHGNPNGSNVILSVND
ASFEWEDFEVQDIKEQKKEEVKATNGKKSKLFFKKSKPQMTKDSPKNEPTEKNDDSTT
KMFTKFEKLNFEIKRGEFIMVTGPIGTKTSLLNALAGFMKRVEGEVDCRGNLLMCGYP
WIQNATLKDNILFGSPYIKEKYDEVIRVCSLAADIDVLPAGDMTEIGERGITLSGGQKARI
NLARAVYKNKDIYLFDDVLSAVDSRVGKHIMDECLLGMLGNKTRILATHQLSLIERASR
IIVLGTNGSFDIGTLEELKERNQTLNNLLQYASEEANKEKKTEGDEGDEGDEGANKLTK
RNSSIPTNGQTTSKEERAVNSIKLKIYNSYIHAAVGKWGIVVLPLYVLFVIATTFCNLFSS
VWLSYWSENKFKNRSSSFYMGLYSFFVFAGYLFMNGQFTILCLMGVTASKWLNLKAV
KRILHTPMAYLDTTPMGRILNRFTKDTDSLDNELTESLRLLLSQFANIIGVCVLCIVYLPW
FAIAIPFLFLIFVLVADHYQSAGREIKRLEAIQRSFVYNNINEVLNGMDTIKAYNAEERFL
AKTDYLINKMNEAGYLVVSVQRWVAILLDMIAIAFALIITLLCVTRQFHISPGATGVLLT
YVLQLPGLLNTIMRALTQAENDMNSAERLITYATELPQEAAYKKPEMTPPESWPDKGQI
TFENVSFAYRPGLPAVLHNIDLNIKSGEKIGICGRTGAGKSTIMNALFRINEVLEGDIHIDG
VNISNLGLYDLRRKLAIIPQDPVLFKGTIRKNLDPFHQHSDEELWESLVRGGAIEKDELA
ETKLQKQDENGSFNQMHKFHLDQMVEEEGGNFSLGERQVLALTRALVRQSKILILDEA
TSSVDYETDGKIQSRIMNEFGHCTILCIAHRLKTILSYDRILVLEQGRIAEFDTPWKLFSKK
ESIFRSMCERSSITDGDFIRKE

SEQ ID NO: 31 Nakaseomyces delphensis transporter polypeptide sequence
MGLFNKTTKSSASNNDALTTTESDISIDQKRGSSSSDSPKGQNYELNVNEDSVSILTSGEY
AVKRNKPQTYLNSNDIEKVTQSDIYPQKRLFSFLHRKNIPEVPQSDEEREVPLFHANPL
STFFLWWVIPIVKIGYKRTIQPNDLFKIDKRMSIETLFADFEKNLNFYFEKSRNDYMKRH
PDATPAEMLENSHLKKFTVLKVLFFTFKRQYLLSVLLAILANCASGFNPMLTKRLIRFVE
EKAYFPHLHVNKGVGYAIGACLMMFLNGILFNHFFHASMICGVQAKSVLIKAAMKKMF
KASGYARHKFPNGKVTSFVTTDLSRLEFALSFQPFFLAGFPAILAICIVQLIVNLGPISLAGV
GVFFGGFCISLFAFKWILALRISANIFTDQRVTMMREVLTNMKMVKYYAWEDAYEKNI
QDIRSKEISRVRRMQMLRNFLIAMAMSLPNIASLITFLSMYRVNNDARTNPAKVFSSLSL
FQILSLQMFFLPIAIATGIDMIIGLNRLQELLEAPESADPFDPESIVNLVHKNEKKIDPRSDI
ALAMKDASFEWEDYELNDAEEEKNSKDDKDAKKTNKEHVTELPIEIDNSSNSKMVKES
TPGLDKKTFTKFTELNFEIKKGEFIMITGPIGTGKSSLLNAMAGFMPQTSGELDINGHLLL
CGYPWIQNATVRDNIIFGAPYNKEKYRTVIEVCSLQADLDILPAGDLTEIGERGITLSGGQ
KARINLARAVYKNKDIYLFDDVLSAVDSRVGKHIMDECFLGAIKDRTRILATHQLSLIEK
ADRVIVLSTDGSVDVGTVEELKERNQTLINLLKFSSENKDEEEVIDEEEDEEEDPMKKEM
AEIEKEITRKSLAKEGLTMTKEERAVNSIGWNIYREYIVTAVGKWGIVIIPLYAFLIMATT
FCNLFSSVWLSYWTENKFPHRQPSFYMGLYSFFVFGGYIFMNSQFTILCVMGIMASKWL
NLKAVKRILHAPMSYLDTTPLGRILNRFTKDTDSLDNELTENIRLMLSQFANLVGVCVL
CIVYLPWFAIAIPFLLLVFILIADHYQSAGREIKRLEAVQRSFVYNNLIEVLGGMDTIKAY
NSQERYLTKMDFLINKMNEASYLVVSVQRWVAIFLDMIAVAFALIIALLCVTRQFKISPA
AVGVLLTYVLQLPGLLNTILRALTQVENDMNSAERLVTYATDLPQEAAYRKSDFSPPEY
WPRTGEIKFENVSFSYRPGLPIVLKNVNLSIGGGEKIGICGRTGAGKSTIMSALYRLNELT
TGKILIDDVDTYKLGLYDLRRKLAIIPQDPVLFRGSIRKNLDPFNEFSDDLLWNSLIRGGA
IENEDLAEVRQQKPDDNGSYSNMHKFHLDQVVEEDGANFSLGERQLLALTRALVRQAK
ILILDEATSSVDYETDGKIQARIATEFRDCTILCIAHRLKTILNYDRILVLEKGEIAEFDTPL
TLFNQPDSIFRSMCSRSGINEEDFHEAA SEQ ID NO: 32 Sacharomyces cerevisiae ABC transporter polypeptide sequence
MTITVGDAVSETELENKSQNVVLSPKASASSDISTDVDKDTSSSWDDKSLLPTGEYIVDR
NKPQTYLNSDDIEKVTESDIFPQKRLFSFLHSKKIPEVPQTDDERKIYPLFHTNIISNMFFW
WVLPILRVGYKRTIQPNDLFKMDPRMSIETLYDDFEKNMIYYFEKTRKKYRKRHPEATE
EEVMENAKLPKHTVLRALLFTFKKQYFMSIVPAILANCTSGFNPMITKRLIEFVEEKAIFH
SMHVNKGIGYAIGACLMMFVNGLTFNHFFHTSQLTGVQAKSILTKAAMKKMFNASNY
ARHCFPNGKVTSFVTTDLARIEFALSFQPFLAGFPAILAICIVLLIVNLGPIALVGIGIFFGG
FFISLFAFKLILGFRIAANIFTDARVTMMREVLNNIKMIKYYTWEDAYEKNIQDIRTKEIS
KVRRKMQLSRNFLIAMAMSLPSIASLVTFLAMYKVNKGGRQPGNIFASLSLFQVLSLQMF
FLPIAIGTGIDMIIGLGRLQSLLEAPEDDPNQMIEMKPSPGFDPKLALKMTHCSFEWEDYE
LNDAIEEAKGEAKDEGKKNKKKRKDTWGKPSASTNKAKRLDNMLKDRDGPEDLEKTS
FRGFKDLNFDIKKGEFIMITGPIGTGKSSLLNAMAGSMRKTDGKVEVNGDLLMCGYPWI
QNASVRDNIIFGSPFNKEKYDEVVRVCSLKADLDILPAGDMTEIGERGITLSGGQKARIN
LARSVYKKKDIYLFDDVLSAVDSRVGKHIMDECLTGMLANKTRILATHQLSLIERASRVI
VLGTDGQVDIGTVDELKARNQTLINLLQFSSQNSEKEDEEQEAVVAGELGQLKYESEVK
ELTELKKKATEMSQTANSGKIVADGHTSSKEERAVNSISLKIYREYIKAAVGKWGFIALP
LYAILVVGTTFCSLFSSVWLSYWTENKFKNRPPSFYMGLYSFFVFAAFIFMNGQFTILCA
MGIMASKWLNLRAVKRILHTPMSYIDTTPLGRILNRFTKDTDSLDNELTESLRLMTSQFA
NIVGVCVMCIVYLPWFAIAIPFLLVIFVLIADHYQSSGREIKRLEAVQRSFVYNNLNEVLG
GMDTIKAYRSQERFLAKSDFLINKMNEAGYLVVVLQRWVGIFLDMVAIAFALIITLLCV
TRAFPISAASVGVLLTYVLQLPGLLNTILRAMTQTENDMNSAERLVTYATELPLEASYR
KPEMTPPESWPSMGEIIFENVDFAYRPGLPIVLKNLNLNIKSGEKIGICGRTGAGKSTIMS
ALYRLNELTAGKILIDNVDISQLGLFDLRRKLAIIPQDPVLFRGTIRKNLDPFNERTDDEL
WDALVRGGAIAKDDLPEVKLQKPDENGTHGKMHKFHLDQAVEEEGSNFSLGERQLLA
LTRALVRQSKILILDEATSSVDYETDGKIQTRIVEEFGDCTILCIAHRLKTIVNYDRILVLE
KGEVAEFDTPWTLFSQEDSIFRSMCSRSGIVENDFENRS SEQ ID NO: 33 Scheffersomyces stipitis ABC transporter polypeptide sequence
MEVRLESGSELVRQNRLLSFLLSKNVPHLPTDEERKIYPEGTTNFFYRFFFWWLNPVMR
TGYKRTLEPQDLFKLSDDIKIENMANRFYHYFERDLERARTKHVEKKCKERGETLATTK
VDPEEDLKDFELSKFTTVFALFKTFKYQYSAACVFLCMANSASTCNPLLLKKLIQYVER

| Illustrative Sequences |
|---|
| KALGVEEGIGRGLGYSFGASAIVFLIGVSINHFFYRSMLTGAQAKAVLTKALLDKSFRLS
AEAKHKYPVGKITSMMGTDLARIDFAIGFQPPLIIFPIPIIIAVAILIVNIGVSALVGVAILAF
FFCAIAVSTRKLFAYRFTANKFTDARVDFIKEALNNLKIIKFYSWEPPYHENISDIRRKEM
RIIYRMQVLRNIITAFSMCLTLFASMISFLVLYAVDKNRKDPASIFSSISLFNVLTQQVFLV
PMALSSGADAYLGIGRVGEYLSSSETNLEETRIHADGEKLIEMDKENVAIEIDGAHFEWD
TFDDDEEEDLDDEDDKDKAEEGHDEKPKQALSASAKHHTHKETFLEKKDSTKTFVPFP
GLTNINLTINKNEFVVVTGLIGTGKSSLLNAMSGFMRRTSGSVNVDGELLLCGYPWVQN
ATVRDNIVFGSEWDEEKYNNVIYACSLESDLEILPAGDQTEIGERGITLSGGQKARINLA
RAVYAERDIILMDDVLSAVDARVGRHIMNNCILGLLKDKTRVLATHQLSLIGSADKVVY
LNGDGTIDVGTFEELKARNISFANLMAYNSEAKEEEEEEEVEEDEEVVENEREMIQRQLS
KVTKPEDEEAEHKDFNKNEHRDGHLTEQEERAVNGINAEVYQQYIKLGSGKFSPWLFC
PLLVSLMILSTFCQLFTNTWLSFWTEFKFTNKSGFYIGFYVMFTVLSFILLTCEFVMLVY
LTNTASVRLNIMAIEKVLHAPMAFMDTTPMGRILNRFTKDTDVLDNEIGDQLRFLVFVF
ANIIGVLILCVIYLPWFAIAIPFLGFLFVAVANYYQASAREIKRLEAVQRSFVYNNFNETL
SGMNTIKAYNAEYRFLEKNNELIDNMNEAYYLTIANQRWLAIHMDIIATIFALLIALLCV
NRVFNITAASVGLLLSYVFQIAGQLSMLIRTFTQVENEMNSAERLASYAFHLPEEAPYLI
NERTPAPSWPDKGIVKFDNASLAYRPGLPLVLKNLSFEVKPSEKIGICGRTGAGKSSIMT
ALYRLSELESGKITIDDVDIASLGLKDLRSKLSIIPQDPVLFRGSIRKNLDPFNESSDSKLW
DALVRTGLIDPSRLDIVKKQVKTQSTEDEEGSIIHKFHLDQQVEDEGSNFSLGERQLIAFA
RALVRDSKILILDEATSSVDYETDFKIQTSIIKEFSQCTILCIAHRLKTIINYDRILVLDKGEI
KEFDTPWNLFNISNGIFQQMCQKSNITEEDFANLKNF SEQ ID NO: 34 *Scheffersomyces stipitis* ABC transporter polypeptide sequence
MSDYDLEENHLVRQNRLLSSLFSKELPPIPEDDERPEHPERDANFFSKIFFWWMIPVMNT
GYKRTLTPKDLFTLSDDIKVETMAARFMAIFTSDVERAKLKHVKKKCKKRGETLESSSV
DFDTDVEDFKVSPIMFFFTIWKTYKYQYFAASVCLAIANSAQAVNPLLFKKLITYVGLK
AYGIEQGVGKGVGYAIGSCLIEFLGAVLFNHFFYKAMMTGAETKGVLTKALLEKSFRLS
AESKHKFPVGKITSMMGTDLSRIDLALGLQPPIFVFPIPIVISIAILIVNIGAVALIGIGVMLL
FMAVIGGTTAKLYSRTKANKYTDIRVSYMKEVLNNLKMIKFYSWEPPYYENISSTRTK
EMDIIYNMQTLRSIVTALAMSLTGFASLVAFLVLFAVDNDRKNPASIFSSISLFNVLLTQV
FMLPMALATSADAFAGVGRVSTFLTTGEVDPKELETDISADVLQRMDKEDVVIEVNNA
SFEWEIFEDIEEKDPKKEKEEKKKAKKAAKETKKLAKQAKNSQTITPSEEELSKIDSPKFT
EKELSTESKSVEEKVFAGLNNINLSIKKNEFVVITGMIGSGKTSLLNALSGFMKKTSGEV
LVSSSLLLCGYPWIQNTTVRENIVFGSEWDEEKYNRVIFACSLESDIEILPGGDLTEIGERG
ITLSGGQKARINLARAVYGGREIILMDDVLSAVDARVGKHIMNNCILDLLKDSTRILATH
QLSLIDSADRVIFLNGDGSISVGTNEELQKSNPGFAALMAHNAKTEEDDEDEKIDVDLD
KQKFEEHHEVEKELIQRQVTRASAVDEEAIRKDYNKNVEEDGHLIEDEDRGVNAIALDV
YLTYVKLGSGKYTAWGIVPPMLVFMALATFCQIFTNTWLSFWTENKFSGKDDNFYIGIY
VMFTVLSFVFLALEFMSLVYMTNTAAVKLNIAAVQKVLKVPMAFMDTTPMGRILNRFT
KDTDVLDNEIGEQINFALFMLSNVVGIIILCIIYLPWFAIAVPFLGFMFIAVSNYYQASARE
IKRLEAVSRSFVYNNFNEVLNGINTINAYKAESRFVAKNDRLINGMNESYYLTIGNQRW
LGIQMNIIAVLFSLLIALLCVNRVFKISPASVGLLLSYVFSIGGTLSMLIRTFTQVENEMNS
VERISYYSFSLPQEAPSYITENSPPPEWPAKGEIHFKDTSLAYRPGLPLVLKNLNFSIKGSE
KIGICGRTGAGKSSIMTALYRLSELDGGSIVIDDIDISTLGLHDLRSKLSIIPQDPVMFRGTI
RKNLDPFDQSTDDQLWGALVRTGLVEADRLDVVKAQVKVQKEDKSDHGDNNNGADK
KGAEEGSILHKFHLDQMVEDEGVNFSLGERQLIAFARALVRNSKILILDEATSSVDYETD
AKIQNSIVNEFADCTILCIAHRLKTIINYDKILVLDKGEIKEFNTPWNLFKTKDSIFQQMCI
KSNIVEEDFHRVSKF SEQ ID NO: 35 *Paraphaeosphaeria sporulosa* ABC transporter polypeptide sequence
MSGSGTSSFNEKEVDWRIQDQEAAAVDSKQYESIVNKPLETAKVEKDLEAHVDKQSVR
GGRLLSRLHSAQSGASEWSSELSDTKSSASGRKKWYKRMNPLKWGNKPPVPETRLPSR
EYSAGFFSRLTFQWMAPLMTVGYKRPLEKNDLWTVNPDRSADVMVERLQASFKRRRE
AGEEKLLLGALFDTFKWEFIIGGACQLFASIIQSVAPFVLRYLISFALKAYIAQHNGGPAP
PIGEGIGLVIGITAMQFFQSMATNHFMYRGMMIGGEARAVLISVIFDKAMKLSGRAKAG
GKAVLEKPPPDVKAGSEAERRWYHKMLKKKQGKLAQGPQGVSGDGQGWANGRIINL
MSTDTYRVDQASGFFHMIWCSPIAILITVALLLINLTYSALPGIGLLIVTMPLLGRAVRSLF
RRRMAINKITDQRVSLTQEILQAVRFVKYFGWETSFLERVDAIRRKEIKGIQILLAIRNGI
MAVGMSMPVFASMLAFITYSLTDHGLNPARIFSSLALFNSLRIPLNFLPLVIGQVIDANAS
VKRIQEFLLAEEAQEDTEWNYDAKEAVVIKDADFTWERHPTREDEDGPPGKGAPGKKI
KENKDKRKSVQSTASSGSGSATNSAEKAGEEDLPFQLKELNLSIGRKELIAVIGGVGSGK
SSFLAALAGDMRRTKGEVMIGASRAFCPQYAWIQNATVRENIVFGKDFRQDWYNKVV
DACALRPDLDMLPNHDKTEIGERGITVSGGQKQRMNIARAIYFDADIVLMDDPLSAVDA
HVGRHIMDNAICGLLQDKCRILATHQLHVLDRCDRIVWIEEGRIQAVDTFPNLMANNRD
FRQLMTMTATEETKDEQEHAIEDEIEDEKKMAQKKKKKKPAALMQEEDRATKAVDWD
VWLAYLRAGGGLWVGPIVVALLILSQGANIATSLWLSWWTSNKFGYSEGAYIGVYAAL
GASQALLMFAFSIAVSVFGTEAGKVMLHRAIHRVLRAPMSFFDTTPLGRITNRFSKDIDV
MDNTLTDAIRMYFMTLAMIISVFILIISYYYYYAIALGPLFLVFMFSAAYYRASAREVKR
HESVLRSNVFARFSEAVMGTSTIRAYGLEHQFSRSVRAAIDDMNSAYYLTFANQRWLSV
RLDVIGILLVFTTGILVVTSRFSVNPSIAGLVLSYILTIVQMIQFTVRQLAEVENNMNATER
IHHYGTMLEEEAPLKMGEVRKTWPEHGEIVFQNVEMRYRDGLPLVLKGLDMHVAAGE
RIGVVGRTGAGKSSIMSTLFRLTELSGGSIIIDGVDISTIGLHDLRSKLAIIPQDPTLFKGTIR
SNLDPFNEHSDLALWGALRQADLVSNEATLDDKSGRIHLDSIVEEEGLNFSLGQRQLMA
LARALVRGSQIIVCDEATSSVDFETDQKIQKTIVDRFRGKTLLCIAHRLKTIIGYDRICVM
DAGTIAELDKPIHLYDRGGIFKSMCDRSGIRREDFFTA SEQ ID NO: 36 *Wickerhamomyces anomalus* ABC transporter polypeptide sequence |

Illustrative Sequences

MSSNASVAESKDLVDLEQNILSKQRPVHRLLTPFLTKKVPEIPKESERKPYPLYHTNLLS
KFFFFWLIPLLNKGYKRTLLQEDLWHLDEKTSIDYVYERFEANLTKRIVTYHLKNPDLE
NKDEIPRFAIVMAILETFKWEYFIASFARVLGNIAITFSPLVSRDLINFIQQKSLNPDLKVN
KGVGYSIGLTLLLIASAILFNQSLQYAKLVGGHSKTILTKALLNKSLIANAETRYKYPSGK
IISFMSADLSRIDLALGFFPLVVAFPVPIIIGIVLLIVNLGVSALAGIAIFILTFIVMSTPASAM
FKLRIKANKFTDERVSLMREILQSMKMVKFYSWEDAYEKLVTVIRNKEIKYVFKIQLVI
NIISTIALNSASITSMGAFLVLYAVRSHGNPAAVFSSLSLFNLLAVQVTNIPIILSYCADAL
SAIDRITKYLQSPVEFDAVENFYDNSIIDPKSKVAVKIENGEFEWPEFEELKEDDTKDVK
KTKPKPKKKWSLFDKKPETSNDAQEVKTESEEKELNELPNESTEEHEKKFSGLHDINLN
VYQGEFIVVTGSTGSGKSSLLSAIASFMAKRSGSIGVNGSLLLCGQPWVQNSTVKENILF
GEQYDSKRYKSVIEVCALESDLKSLPAGDLTEIGERGVTLSGGQKARVNLARAVYSLNK
DIYLLDDILSAVDANVGKHITKYCLMEYIGDRTRILATHQLSLIKKADRVVFVNNDGTID
VGTENELREKNPQFVALMEFNKEHESGDHKENDQIAKVTSVNDEAKPGEENGALFGEE
ERAYDSIPFSIYKQYAQAGQGVFGFSAFIILLFLMILAVFLTLFTNVWLSFWVGNRFKSLS
NGTYIGLYVGFTILSCVFIALEFTMMGYINTEASKVLNLQAVKRVLHTPMSFMDTTPIGR
IINRFSKDTNSLDNEISLQLKLFLHFGAVIIGILILAIIYLPWFAITIPFLLIMFLVITNYYQAS
SREVKRLEAINRSFVYNNFNEVLNGLNTIKAYGAQNRFMKKNDKFVDRLNEVYFVVIA
NQRWIAVNLDTLAGLIVFIVAMLSVTRQFNISPSSVGLLTYYMIEFSQLLSFISTSYTEVEN
EMNSVERVCHYANNLEQEAAYRRSEFKPAPEWPTKGEVSFQNVSSRYREGLPLVLNNL
SFVVDGSSKIGICGRTGAGKSSLVSTLYRLSELAGGEILIDGVDISQLGLFDLRSKLSIIPQD
PVLFQGTIKKNLDPFNEATDDELWDAMRRGGLISTEKFGTIKTQTENQDKFHLNSKVED
EGANFSLGERQLLALARALVRRSKILIMDEATSSVDFETDAKIQKTIAEEFKECTILCIAH
RLKTIIKYDKILVLEKGELEEYGEPTELFSKGGIFREMCESSDITADDFK

SEQ ID NO: 37 Kerivoula Africana ABC transporter polypeptide sequence
MGPNINHTVDNIPSNSSSKMDEDDEYYKTSSNTSSLDSSSDEFSYLPTGEYKVQKNKPKT
YLNIDDIERVTDSEIFPQKRLFSFLHSKKIKEVPTNDDERPIYPFFHANIISRTFVWWVMPI
LKVGYKRTIQPNDLFRMDPYFSIEKMSSDFDKNMDYYFQKTYNKYRKEHPNATEDEVY
EHAKLPKLTVFKALFWTFKRQYITSCICAILANCASAFNPMITKRLLEFVERKAVLKHMK
VNDGIGYAIGACLMMLFNGILFNHFFHNSQICGVQAKSILTAAALNKMFRASKYARHKF
PSGKVTSFVTTDLARIEFALSFQPFLIGFPPLLIICIVLLIVNLGAIALVGIGLFFVVAVFVM
VIFKKIVDLRMSANTFTDARVTKMREILNNMKMVKYYAWEDAYEKNIQEIRSEEISRVR
KMQYIRNGVIALAISLPNIASLATFLSMYKVNNMGRTPANVFSSLSLFQVLALQMFFMPI
ALATGIDMMIGLGRLQDLLQAPEEHSRLIEDRKPDPEVEKSNIALKLDNCSFEWDDFEEL
DLLEEAEKKKKEKKKNKKKKDDPKAKTKKSLKKEKENNEIEKAFSKFSNLDFEIRKGEF
IMITGPIGTGKSSLLNAFAGFMNKTEGRIQVNGDLLFCGYPWIQNATVKDNILFGSPFIKE
KYENVLRVCSLDADLKVLPAGDKTEIGERGINLSGGQKARINLARAVYKTKDIFLFDDV
LSAVDSRVGKHIMDECLLDLLEGKTRILATHQLSLIEKADRVIVLGTDGSFDIGTVDELK
QRNQTLTNLLDYSTTERENENRDESPVADEENDELLIQEELKIQLLQTTTRNEDAEDVSG
GDGHLIEKEERAVNSIGWEIYKQYIIAGVGKWGFVVIPAYILFIVITSFCQVFSSVWLSFW
TEDKFPTRSPSFYMGLYSFFVFGGFVFMCVQFTTLCSIGVLASKWLNLNAVHRVLHAPM
SYLDTTPLGRILNRFTKDTDSLDNELTESVRLMLFQVGNIVAVIVMCIVYLPWFAIAVPF
LFFMFVLIADHYQSTSREIKRLDAIQRSFVYNNLNEVLGGMDTIKSYKGQKRFQAKSDY
LINKMNEAGYLLVSVQRWVSIFLDMVAIIFALIIALLSVTGVFSLSASSVGVLLTYVLQLP
GLLNSVLRALTQTENDMNSAERLVNYATKLPLEAAYKKPELSPPESWPSKGEIRFLDVD
FAYRSGLPVVLKGLNLDIKSGEKIGICGRTGAGKSTIMSALYRLNELTSGKILIDDVDIST
LGLYDLRRKLSIIPQDPVLFKGTIRKNLDPFSNYDDSLLWDALIRSGAIEKESVEKVKSEM
VNEEGTHTDMHKFHLDQLVEEEGSNFSLGERQVLALTRALVRQSKILILDEATSSVDYE
TDGKIQKRIVEEFDNCTILCIAHRLKTILQYDRILVLEKGVIAEFDQPFKLFSDKDSIFRSM
CERSNITESDFKIQK SEQ ID NO: 38 Naumovozyma castellii ABC transporter polypeptide sequence
MPPPKKANRSSVISSSSLSSSSGDRSITDNSKLDDMIAGETINISPQDPFKDTPELDVTSAT
SGTISKMVSDDISSMMDSSLLPTGEYKLDRNKPETYLNSDDIEKVTQSDIFPQKRLFSFLH
SKKIPEVPSSDDERKEYPLFHANILSQLFIWWVIPIIKTGYKRTVQPNDLFKMDKRMSIET
LHDAFQKNMDYYFKKAEQKYLKSHPNATNEELAKHMKLPKWTVLKAIVFTFKRQLFV
ATVFAILANCTSGFNPMITKRLIEFVEKKTFFHDMTVNAGIGYAIGACIMMFLNGVFFNH
FFHLSQLTGVQAKSVLTKAALNKMFRASNYAKHQFPNGKVTSFVTTDLSRLEFAISFQP
FLFGFPAVFAICIVLLIVNLGAISLVGIGVFFSAFFACLFIFKQILGLRVVANKFTDARVTL
MREILNNMKMVKYYAWEDAYEKNIQDVRGKEINTVRKMLFIRNFVIAMATALPSVASL
VTFLCMYKVNNMGRTPGNVFSSLSLFQVLSIQMFFLPIAISTGIDMVIGLGRLQSLLESPE
DDPDLQLERLPAPDLNPNVALKMEDGAFEWENYELLDAQEKAEAEEKLKKEIEDYNQK
WYHFKKKTMPNPEELAKESTNAIDKTAELKLKKDLMEDKDAIEKIPFNGFHDLNFEIKK
GEFIIMVGPIGTGKTSLLNAFAGFMNKVSGRIQINGDLLLLCGYPWIQNASVKDNIIFGSPY
NKAKYDEVIRVCSLKSDLDILPAGDLTEIGERGITLSGGQKARINLARSVYKQKDIYLFD
DVLSAVDSRVGKHIMDECFLGLLDKTRILATHQLSLLERASRVIVLGNDGSFDIGTVEE
LKQRSSTLVNLLQFSSQTAEKEEDEENENQEEEMEKLEKQMTEISKVLSRKEAVDGHTT
MKEERAVNSISLKIYKEYLKAGVGKWGIVVVPCYLILIMCTTFCSLFSSVWLSYWTEDK
FKNRAPSFYMGLYSFFVFFSYILTTSQFTLLCCIGVLSSKWLNLRAVKRILHTPMSYLDTT
PLGRILNRFTKDTDSLDNELTESVRMLLYQFANIVGVCIMCITYLPWFAIAIPFLFVGFVLI
ADHYQSSGREIKRLEAIQRSFVYNNFNEVLGGMDTIKSYRSENRFIAKSDFLIDKMNEAG
YLVVAVQRWVAIFLDVIAVCFALIITLLCVTRAFPISAASVGVLLTYVLQLPGLLNGVLR
SLTQTENDMNSAERLVTYATELPLEADYRKPEVSPPEEWPTKGEIHFENVDFSYRPGLPT
VLKNLSLDIKSGEKIGICGRTGAGKSTIMSALYRLNEISSGKMIIDDVDISTIGLYDLRRKL
AIIPQDPVLFRGTIRKNLDPFNEHQDEHLWNALVRGGAIEQKELNEIKAQKPDEKGNHSE

| Illustrative Sequences |
|---|
| MYKFHLDQLVEEEGANFSLGERQLLALTRALVRQARILILDEATSSVDYETDGKIQARIV
EEFGHCTILCIAHRLKTILTYDRILVLEKGEVAEFDTPKTLFAQEDSIFRSMCQRSGITEED
FI SEQ ID NO: 39 *Cyberlindnera fabianii* ABC transporter polypeptide sequence
MAKDGIVTSTEAPLKDAESGQLVLERRLLTPLLSKKVPPIPTDEERKFYPFKKANPISKVF
FWWLNPIMNVGYKRTLTPQDLFKLTPDMTIDHTYEKFDRYLTKIVEKDRAAALKKDPS
LTPEDLERREYPKFAIIKALFLTFKWEYSTAIMFKVFADVCGVCNPLLSKELIKFVSRKTL
NADIAVNDGVGYAFGCTLLLAFSGIFINQFLHLSITTGAHCKGILTTALLKKSFRADAETR
HKFTSGRITSLMSTDLARIDLAIGLQPFGWTFPIPVIIAIALLIVNIGVASLAGIAVFIISILVI
GGSAKALLKMRRGANKFTDKRISLMREILQSMKMIKYYSWEDAYESSVVEQRNSEVGV
ILKMQSIRNFLLAFSISLPSFTSMIAFLVLYGISSNRNPANIFPSISLFGSLAQQTMMLPMAL
ATGTDAMIGLNRVREFLQSGVDLEDPEAPQGNDQDSQDANVEKLPEDVALSVKNATFI
WETFDDEEDEGADKPKADTATEKKDSDIATPATSTKDTHSDSELKNTASSTEEEGHESY
TKSVFEGFHNINLDVKKGEFVIVTGAIGSGKSSLLIALAGFMKQTGGTLTAAEDVLLCGA
PWVQNTTVRENITFGLPYEEERYERVIDACALRDDLKLFAGGDLTEIGERGITLSGGQKA
RINLARAVYADKSIVLFDDVLSAVDARVGKHIIDDCFGEYMKGKTRVLATHQLSLVDK
ADRVVFLNGDGTLHIGTVEELLTSNEGFIKLMEFSKKSSEDDEEEDEDIDEEEQEIIALQK
SQSLAVIQSKKNNNDAAAGVLVNEEERAKNKISSKVYTEYLREGGGILGKFAAPIAILLL
ILDVFTTIFINVWLSFWITYKWKNRSDGFYIGFYVMFVVLNICFIASCFVLLGYISTTSARE
LNLKAMRRILHAPMAYLDVTPMGRILNRFTKDTDVLDNELGEQLRLFLHPTAFVIGVIIL
CIIYLPWFALVIPPLLVVFSCVTSYYQSSSREVKRLEAVQRSFVYNNFNEVLNGMSTLKA
YRATSRFLKKNNVSVDRMNEAYFVVIANQRWISIHMDMVAVCLLFVVAMLAVTRQFSI
SAASAGLVVTYVMQIGGLMSLIMRAYTTVENEMNSVERLCQYANDLVQEKPYRINETK
PSPSWPESGSIEFEGVSLRYRDGLPLVLRNLTLAVAGGEKIGICGRTGAGKSSIMTALYRL
SELAEGRILIDGLDISKMGLFELRSKLSIIPQDPVLFQGTIRRNLDPFGESDDQHLWDSLRR
AGLIDSSVLATIKAQGKEDKNFHKFHLDQAVEDDGSNFSLGERQLLALARALVRNSRILI
LDEATSSVDYETDAKIQSTIKSEFSECTILCIAHRLKTILDYDKILVLEAGEIEEFGTPMTL
YENDGIFRQMCDRSDITREDFVHDL SEQ ID NO: 40 *Lachancea mirantina* ABC transporter polypeptide sequence
MPTIRQELRHSSSGSENEKAESLYVKNEGKLDKVATQNSYYEVDRNRPETFMNSDDLE
KVTESEIYPQKRMFSFLHSKKIPPIPTDEERPVYPLFHANWISRIFFWWVFPILRVGYKRTL
QPGDLWKMDDRMSIETLYADFERYLEVYREKARVQYRKEHPNATEEEIIENAVMPKHT
LVKVLLYTFKWQYFLAFAAMALSNAASAFLPMVTKRLIDFVSEKSFYPGLKVNAGVGY
AIGSCVMMLLNGVLFNHFFHNSQLTGVQAKSVLIKAILTKSMKLSGFSRHRFPSGKITSI
MSTDLSRLELAIIFQPLLGAFFVAVAICIVLLIINLGPIALVGVGIFVVAMFFSAYAFKRLIS
VRKKTNIFTDARVTMMREILNSMKMIKFYAWEDAYEASVHDQRSKEISKTRIMQFTRNF
VTALAVCLTNISSMVTFLALYKVRNHGRTPANIFSSLSLFQVLSIQMFFLPMALGTAVDG
SIALNRCQELFEATEEEHDIDVDFPPCDDPDLALKVVNGSFEWQDFEAEENRLATLMEIE
EKKKKKTKSKKDKAPEPKHEAASIKPGHLSDTERESFKGFHNLNFEVKKGELIIITGSIGT
GKTSLLNALAGFMRKTEGDVYKNGSLLLCGYPWVQNATVRDNILFGSPYDKARYKEVI
RVCSLQADLDILPANDKTEIGERGITLSGGQKARINLARSVYKSMDTYLFDDVLSAVDA
RVGKHIMDECMLGRLGNKTRILATHQLSLIDRASRVIFLGTDGSFDFGSVTELKKRNAGF
NKLMEFANKSSDKEEGELDSTEASGDDVSTAEELEHFRDDDGQREMDASRLKKELSKR
SYESSVDENEAAGRLMAKEERAVNSIGFDVYKNYISAGVGKKGFVLLPFYVILLAVTTF
SLLFSSVWLSFWTEDKFKRQAGFYMGMYIFFVFFNYFCTTGQFTLLCYLGLTASKMLNL
KAVKRILHTPMSFIDTTPIGRILNRFTKDTDTLDTELTESVRLFVYQTANIIGVVIMCIIYLP
WFAIAVPFLVIIFALVANHYQSSSREIKRLEAIQRSHVFNNFNEVLGGIDTIRAYRGQERF
LMKNDFLTNKMNEAGYLVVAVQRWVSIALDMIAMAFALIIALLCVTRQFHISPSSVGVL
LTYVLQLPGLLNTLMRAMTQGENDMNSAERLIAYATDLPLEANYRKPEMTPAEPWPSH
GEIVFDDVSLAYRPGLPLVLKNVSIDIGSGEKIGICGRTGAGKSTIMTALYRICELHSGTV
SIDGVDISKIGLYDLRSKLSIIPQDPVLFKGSIRRNLDPFNERTDEQLWDALVRSGAVEAS
EIAEVKAQSPETSGAYANMHKFHLRQEVEDDGSNFSLGERQLLALTRALVRQSKILILDE
ATSSVDYETDAKIQAKIVQEFSSCTILCIAHRLNTILDYDRILVLEQGSVAEFDTPKALFR
AGGIFTEMCQRSGITSADFKEN SEQ ID NO: 41 *Pachysolen tannophilus* ABC transporter polypeptide sequence
MAEDESSSIQVFEKEKNGKSHAMIEEAQPVEYMKQRRLFSPLFSKKVPPIPTPDERKPYP
FRKANIIYKIFFWWLMPLMNTGYKRTLQQEDLWYLDGDLKIEEYYAIFEKRLAKRTQK
AREAHLKLLEEKKKNGTFDPNEDNEFEFEYPRYSLVWALFDTFKWEYSLSIVFVALADV
GFTLNPLLSKALIDFVEDRVLGYKTNIGHGVGYAIGCSALVSVSGILINHFFNLSTQVGA
KSKATLTKAMLEKSFKLNAKGRHNYPASKITSMLGTDLSRVDLGIGFQPIAIVFPIPVAISI
ALLIVNIGVSSLAGIGIFIISTIIIALATKKLFSYRKKITKFTDSRINYMKELLNNVRIIKYYS
WEPSYKETIADVRTSEMYNIFKLQILRNFLTAYAVCLPQISSMVSFLVMYAVDKNRSAG
QIFASLSLFNVLSQQIMMLPLALATGSDALVGIDRVRGLLQGSGEDDPKDRESSYVDVDL
IEKKLAISVRNATFQWKTFEQIDESVSPSKEEEEKEKQIEREEERLNNINKQLSGNFDQSS
SLSVKHTKFPGLKHLDFDIKQGEFIIITGIIGSGKSSLLNALAGFMDKEEGELKINGSLLLC
GYPWIQNAPVKENILFDSEYDEKKYKDTIYACSLDADLDILPAGDRTEIGERGITLSGGQ
KARINLARAVYAVNDIILLDDVLSAVDARVGKHIMDNCFMGLLKDKTRILATHQLSMIN
SADRVIFLNGDGTVDIGTPDELLKSNAAFLNLMEFSNDEKNTEEEQKEMNDEEDKELKR
QMTEKSLLNDNDEDDEESRKDFTSKTGEAQLIQKEERAINGISFSIYKNYVMAGSGALK
AGMTPVFFFFVILATFFQLFTNTWLSFWTEEKFPGRSSGFYIGLYVAFTCLTIIFVSTEFSLI
VPITNKASKLLNIAAVTNLLHAPMSFFDTTPIGRILNRFTKDTDALDNEISQQLRLFIYPTA
NVCGVLILCIIYLPWFAIAVPFLVALFIGFANFYQASSREIKRLEALARSFVYNNFNETLG
GMTTIKSFKAESRFLIKNNLYINRMNEAYFISLSNQRWLGIHLDLVASAFALIIALLSVTR
QFQISAASVGLLVSYVMQIAGQLSLLIRAMTQVENEMNSVERLDYYAFHLPSEAPFDIPE |

| Illustrative Sequences |
|---|
| TAPPPTWPQHGVVEFKNVSLAYRPGLPLVLNNISFSVKAGEKIGICGRTGAGKSSIMTAL
YRLAELANGEINIDGINIAKIGLNSLRSKLSIIPQDPVLFRGNIRKNLDPFNKHNDDELWG
ALRRSGLIEESELSKVKCQALTDPQLHKFHLDQVVEDDGSNFSLGEKQLIALARAVVRN
SKILILDEATSSVDYETDAKIQKTIVQEFSSCTILCIAHRLKTIVDYDRILVLDKGQVQQFN
TPWVLFNKEGIFQKMCERSKITALDFNRKS SEQ ID NO: 42 *Colletotrichum higginsianum* ABC transporter polypeptide sequence
MADKGEKTNITASDPLAAAVEPITPRDPEDTTFAIEIDETDGNDGGSDSDEKRVRPELRS
TKSHATDTSVATTAATRRQPQSKPWYKTPNPLKWGGIPPVPEERIVSREHRAGFFSLLTF
QWMAPLMSAGYKRQLEPTDIWTVNPDRAADVMTDKLKAAFKKRVDRGDKYPLLWAL
HETYLFEFWLGGMLQLMSTVFQVMSPFTLRYLIQFANDAWDASQQGSPPPAIGRGIGLV
LGVTFMQIFQSLGTNHFIYRGMMIGGQSRAVLISVIFEKAMSLSGRAKAGGIKEPAGSPP
VDEKGKKKDNKGKGKKGEATKGPGISGDGTGWGNGRIVNLMSVDTYRIDQASALFHL
TWTAPISCIITLVVLVINLSYSALAGFALLVAGIPLLTRAIRSLFKRRKAINKVTDQRVGLT
QEILQSVRFVKYFGWESAFLERLKGIRRREIHAIQILLAIRNAINAVSLSLPIFASMLSFVT
YAKTNNALNPALVFSSLALFNGLRIPLNLLPLVLGQVVDAWSSLKRIQDFLLAEEQEED
VVLKLDGENALEMTNASFTWERTTTQESEKSAAGTGKGGKKGTTQPLVASKPATKSEE
PLASSGDSTGDGASTLVGEEREPFKLQDLNFEIKRDELVAVIGTVGSGKTSLLAALAGD
MRKTSGEVVLGASRAFCPQYAWIQNATVRDNILFGKDMDKAWYQEVINACALRPDLA
MLPNGDLTEIGERGITISGGQKQRLNIARAIYFDSDIVLMDDPLSAVDAHVGRHIFDNAIL
GLLKGKCRILATHQLWVLNRCDRVIWMEGGKIQAVDTFDNLMRDHRGFQQLLETTSQE
EEKDETAPVNLTEAPQGDKKKNKKGAALMQQEERAVASVPWKVYGDYIRASGSMLN
APFLIFLLLLSQGANIMTSLWLSYWTSRRYPLSDGQYIGIYAGLGALQAVLMFVFSLLLSI
LGTKSSKVMLRQAVTRVLRAPMSFFDTTPLGRITNRFSRDVDVMDNNLTDAMRMYFFT
LAMILSVFALIIAFFHYFAIALGPLFVFFILASSYYRASAREVKRFESVLRSTVFAKFGEGL
SGVASIRAYGLKAHFIGDLRKAIDEMNAAYYLTFSNQRWLSTRLDLIGNLLVFTVGILVV
TSRFSVPPSIGGLVLSYILGIVQMIQFTVRQLAEVENGMNAVERIQYYGTQLEEEAPLHTI
EVRPSWPEKGEIVFDNVEMRYRANLPLVLSGLSMHVRGGERIGIVGRTGAGKSSIMSTL
FRLVELSGGHITIDGVDISTIGLHDLRSRLAIIPQDPTLFKGTVRSNLDPFGEHTDLELWSA
LRQADLVPADANLEDPRSKESSVIHLDSIVEEDGLNFSLGQRQLMALARALVRGSRIIVC
DEATSSVDMETDDKIQNTIATSFRGRTLLCIAHRLRTIIGYDRICVMDAGRIAELDTPLAL
WQQEGGIFRSMCDRSGIRLEDVRMASEGMALEVQVGQSSQGGL SEQ ID NO: 43 *Candida auris* ABC transporter polypeptide sequence
MSNHDYYRDLYGPRSDRNPYEAPHNDNFVATPSYHYYVQQQQRHQGNPAGTTHLHPT
ISDHSDTTTTYVEYQSDDSLADEPSMQQQQQRQHEKKKAKKKKVPRVPRFRRDKRAGA
GAGAGAGSGSGQGDLENGKAELVNEKRLFSFLFSKKVDPVPLPDERKPYPWKLTNWA
NRAVFYWIWPILIRGYKRTLQPDDLWYLTDELTVEHLHREYRKNLKKILDKSKNKHIEK
KGGGEGSDDDWEWPFYAVPLALFNTFRFQYTMSCIFLALSFVCQATSPLITRRLIDFVEY
RYFGIETTYNKGIGYTIGAVILIFVNGLLLNHFFHNAMVAGAACKAILTKDVLIKSFKLSA
KAKHRFTTGRITSLMSTDLSRIDLAIGFQPLVVCFPIPVVIAVVLLLTNIGVTSLVGIGLFV
VSLVVCVLLTSKLFFTRETVVKYTDKRISLMREVLNNLKIIKFYAWELAYKANITKVRN
QEMKYLFTIKVLRNFITAYAVTLPTLTSMISFVTMWKTGNMRDAGRVFSSLSLFSILAQA
IMLLPIALATGADAMIGFRRCKDFLSATEYDSDLDRKLKQEEDEYVIGSDESVSGFEFKG
NHKDNDSFNSDTYYGTEQEKISSLPPNVDIQISHADFVWDQYQGEEDDDSDSLWEPVSK
KSDGINEKTANVKMSSESHSKDAKNSSFPGLLDINLTINSGEFVVITGVIGSGKTSLLNAI
AGFMKMTNPGVGSVTISKDLLLCSQPWIQNATVRQNILFGSPMDRNRYKAILKACCLED
DLKELTHGDQTEIGERGITLSGGQKARINLARAVYRGGDTMLFDDVLSAVDARVGKRIT
DELFFGFLKNTTRVLATHQLSLVASADKIVFLNGDGTIDVGTTEELKARNPGFGKLIEFS
KEDASGAPREETIQSNDNVCLLPSGVGVENEEDVKLAVTSSILPENGAAGDIVGRTVEDE
DKAVNAISWTVYKNYINLGAGIFGYTAAPVFLFLVAIATFCQLFTNTWLSFWMEKRFKQ
LSDHFYVGFYVAFAFLTVFFTGIQFTMLAYMNNRSAELLNVKAVEKILHCPMSFMDTNP
LGRVLNRFTKDTDSLDNEIGEQLRLFIFPLAMIIGIIILCIYLPWFAIAVPFLGCAFFFLADI
YSGSSREIKRLEAVQRSVVYNNFNEILTGMHTIKAYKEEVNFIKKNDSLLNRMNEAYYL
SIANQRWLCVHLDTIAALFALIISMLCITEQFNISPQSTGLLLNYVIQIVGLLSLTVRAMTQ
VENEMNSVERLHQYAFDLPQEAAYEKSETKPPPHWPPYGYVQFNNVNLRYRENLPLVL
KDLTFGAYPDEKVGICGRTGAGKSSIMTALYRLSELESGSITIDNLDISQMGLRDLRSKLS
IIPQDPVLFQGTVRRNLDPFDQYTDDVLWDSLRRSGLISEEQLERVKQTGLVDNNYDQL
HKFHLDQNVEDDGGNFSLGEKQLLALARALVRGSKILILDEATSSVDYETDAKIQETIIR
EFKKCTILCIAHRLKTILTYDRILVMDQGRIVEKGTPWTLYRKNGLFRKMCDKARIVPED
FPPPPNDY SEQ ID NO: 44 *Glomerella cingulata* ABC transporter polypeptide sequence
MADKEEKTNITAPDPQAAAVEPITPKEPEDAAYVIDIDGTDEKNESSDVDEKTARPELKA
TKSHATDTSVATTTANRQPESKPWYKTPNPLRWGGVPPVPEERIVSREYKAGFFSQLTF
QWMAPLMSTGYKRQLEPNDIWTVNPDRAADVMTDKLKAAFQKRVDRGDKYPLLWAL
HETYFFEFWLGGFLQLMSTIFQVMSPFTLRYLIQFANDAWDAANQGQPPPAIGKGIGLV
LGVTVMQILQSLGTNHFIYRGMMIGGQSRAVLISAIFEKSMSLSGRAKAGGLKEGAKSQ
TDDKGKKKETKGKKGDAKGPAISGDGTGWGNGRIVNLMSVDTYRIDQACALFHLTWT
APISCVITLVVLCINLSYSALAGFALLVAGIPLLTRSIRSLFKRRKAINKTTDQRVSLTQEIL
QSVRFVKYFGWESAFLERLKEIRSREIHAIQILLAIRNAINAVSLSLPIFASMLSFITYAKTN
NALNPAEVFSSLALFNGLRIPLNLLPLVLGQVVDAWSSLKRIQEFLLAEEQEEEVVYKPE
GENALEMHNGGFTWERTPTQESEKTVGGKGGKKAPAQPAAAKKTEEPVTSSGDSTGD
GASTLVEEEREPFKLQDLNFEIKRDELVAVIGVGSGKTSLLAALAGDMRKTSGEVVLG
ASRAFCPQYAWIQNASVRDNILFGKDMDKAWYQEVINACALRPDMAMLPNGDLTEIGE
RGITISGGQKQRLNIARAIYFDSDVVLMDDPLSAVDAHVGRHIFDNAILGLLKGKCRVLA
THQLWVLNRCDRVIWMEGGKIQAIDTFDNLMRDHRGFQQLLETTAVEEKEDDAPPTNL |

-continued

Illustrative Sequences

TEAPAVDKKKNKKGAALMQQEERAVSSVPWKVYTDYIRASGSILNAPFLIFLLLLSQGA
NLMTSLWLSYWTSKKYPLSDAQYIGVYAGLGAVQALLMFIFSLLLSILGTNSSRVMLRQ
AVTRVLRAPMSFFDTTPLGRITNRFSRDVDVMDNNLTDAMRMYFFTLAMIISVFALIIAF
FHYFAIALGPLFVFFILAASYYRASAREVKRFESVLRSTVFAKFGEGLSGVASIRAYGLKS
HFIADLRKSIDEMNAAYYLTFSNQRWLSTRLDLIGNLLVFTVGILVVTSRFSVPPSIGGLV
LSYILGIVQMIQFTVRQLAEVENGMNAVERIQYYGTQLEEEAPLHTIEVRPSWPEKGEIV
FDNVEMRYRANLPLVLSGLSIHVRGGERIGIVGRTGAGKSSIMSTLFRLVELSGGHITIDG
VDISTIGLHDLRSRLAIIPQDPTLFRGTVRSNLDPFSEHTDLELWSALRQADLVPAGANLG
DPRSKDPSRIHLDSVVEEDGLNFSLGQRQLMALARALVRGSRIIVCDEATSSVDMETDD
KIQNTIATSFRGRTLLCIAHRLRTIIGYDRICVMDAGRIAELDTPLALWQREGGIFRGMCD
RSGIRLEDIRGASEEMGSKDQAGESSQI

SEQ ID NO: 45 ABC transporter polypeptide sequence
MKSDNIAMEDLPDSKYLKQRRLLTPLMSKKVPPIPSEDERKAYGEYYTNPVSRMMFWW
LNPILKVGYRRTLTENDLFYLEDRQRTETLYEIFRGYLDEEIARAWKKSQESSDDPREFK
LPIYIIPLCLFKTMKWEYSRGILQKILGDCASATTPLLQKKLINFVQVKTFSNVGNTGQGV
GYAIGVCLMIFFQVLMLTHAFHNFQISGAKAKAVLTRLLLDKSLTVDARGNHYFPASKI
QSMISTDLNRIDLAVGFAPVGFVTIFPIIICIALLIWNVGVSALVGIGVFIANIFVLGLFVSSL
MLYREKAMVFTDKRVNLVKELLKNFKMIKFYSWENSYQDRIENARNNEMKYILRLQLL
RNFVFSLAFAMPVLASMATFCTAFKITDGKSAASVFSSLSLFEVLSLQFILAPFSLNSTVD
MMVSVKKINQFLQHKDTNPNEFSVEKFSDSTLAIKVDNASFEWDTFEDEEKDYEEEAKT
KDNIEDEDHNCATETIKGKITVDYKSDSDSISSTLTKGVKTAFPGLNNINLEIAKGEFIVV
TGAIGSGKSSLLQAISGLMKRTSGEVYVDGDLLLCGYPWVQNSTIRENILFGLPFNKERY
DQVVYSCSLQSDFDQFQGGDMTEVGERGITLSGGQKARINLARSVYADKDIILLDDVLS
AVDAKVGKHIVNTCILGLLGGKTRIMATHQLSLIDSADRMVFLNGDGTIDFGTIPELRKR
NQKLIELLQHQRDPGQDKEDLSNDLDIQGSTDEGQQIEHADEHKEIVKIIGDEEKAVNAL
SFQVVYYNYCKLAFGKLGYISMLVFIIVSSLETFTQIFTNTWLSFWIEDKFVSRSKNFYMGI
YIMFAPLYAIMLCFFLFLLGYFCVKAAERLNIKASRKILHVPMSFMDISPIGRVLNRFTKD
TDVLDNELLEQLIQFLSPLFNCFGIIILCIVYIPWFAIGVPIILGFYFIIASYYQASAREIKRLE
AVKRSFVFGHFHEVLTGKDTIKAYNAIDRMKLKLNKLIDEQNEAYYLTIANQRWLGAN
LAIVSFSMVFVISFLCIFRVFNISAASTGLLLTYVIALTDSITMIMRAMTQVENEFNSVERV
NHYAFDLIQEAPYEIPENDPAEDWPQHGKIEFKDVSMRYRPELPFVLKNINLSVREQEKI
GFCGRTGAGKSTFMTCLYRITEYEGLISIDGVDISRLGLHRLRSKLTIIPQDPVLFVGTIRE
NLDPFTEHSDDELWEALAISGLIEREDLEVVKGQEKIGGNDSGKLHKFHLVRMVEDDGI
NFSLGERQLIALARALVRKSKILILDEATSSVDYATDSKIQRTIASEFRDCTILCIAHRLNTI
LGYDKIVVMDNGEIVEFENPKLLFMRENSVFRSMCEQANITINDFE SEQ ID NO: 46 Wickerhamomyes anomalus ABC transporter polypeptide sequence
MPFFKRKISQETFKSNKEKAQVDSSTVTDIESNANEVLKNPTLKKTSPVIRTIIGKTPAPIE
QNHETYPFLKANFFQALTFTWVAPLIKKGYLRRIEDEDLYQLDGDLKVREMTEKFEQSL
AKRVEEWKRKNPDKEKYTKIVVIKAINDTFKTRYWKGGVSKVFADLSQILNPLLVRTLI
KYIQHKGDNKVVPQTGHSVGTAIGISVMLIFSSLMISSFFHLSMLTGAQCKALLTNVIYR
KAFKLSAKARLDFPNGKVNSLVMADLSRIDLAVGTFHFVWAPPISFIVALIVLVVYLGAP
ALLGLALILILLGFMMYATRKLKNLRRQSTVYIDKRVRSINEIINTLKMIKFYCWEKPYY
ETVEKFRLNEKRFILKMQLLKAILNSGVSSVAVLATMVVFLTMQKTSTNFQSYNIFSAVT
LFNTLRFPLNVLPMAVGFLVDALLAMDRVAEFLQAEEEGEDTVERYEYDESDNAIVIENG
CFKWDVEEDEDFKLKAQMTRQSMKPHQTNEDEEGEDLSFPGLLNIDLTVKKNELVIVT
GSIGTGKTSLLNAIEGSMRKESGDSKIYGSLTFCSYPWIQNETIKENILFGLPFIRSKYESIV
KACALDVDFDVLPDGDQTEVGERGITLSGGQKARINLARAVYADRDIILLDDVLSAVDA
RVGKHIMNECICGLLKDKTRLLATHQLSLIGAADRIIVLDGSGSIDIGTYNELMASNSAFA
KLMEFNKEQEDEEEEEQLEEQEEMELERQKTQISRIQSEKQEDEDARKEKGRITVAEDR
GTQNISFGIYANYMILGSGKLGVAIVPLFLLIVVLNGFFQLFYSVWLSFWISHKFDISDST
YKGLYIMFCFLATFSFVTLFSAMAALNNKAGLHLFNLSAQKLLKTPMWFMDVTPIGRIM
NRFTKDVDVLDTDMIEQLRLFVQSVSLVGGVVILCGVYIPWFFLVLPFVFTLYYYLAHY
YKTSALDIKRLESVKRSFVFSHFNESLSGMKVIKSYSSSERFKDKYESLIDSMDAAYFLTL
ANQRWLSIRLDCISSLVSFFVAMLCIFGVFNMDGASSGLLVSYIIQIASMMSLLLRSMTQL
ENDMNSVERLFEYAKKLPEEGPFELEDNKPDESWPEQGGIEFDDVCLSYREGLPLVLKN
VSFKVNPSEKIGIVGRTGAGKSTIMNALFRVTELAQGRVIIDGVDISKIGLNDLRSKLSIIP
QDPVLFHGTIRQNLDPFGASSDFDLWDALKRSWLVEDGAAGTGQFVAGKSDIKTLHKF
HLDQKVEDDGANFSLGERQLLALARALVRNTRVLILDEATSSVDYETDSKIQSTIINEFR
QCSILCIAHRLKTILNYDRILVLDKGEVKEFDTPLNLFKLGGIFTEMCERSNITETDFGA SEQ ID NO: 47 Wickerhamyces ciferrii ABC transporter polypeptide sequence
MVDVEQQTVYPEGYNKDDMILQKRLMTPLLSKKVPQIPNQDERKRYPYMHSNYISRIFF
WWIIPLLNIGYKRTLTSNDLYKLEDDMSINHTYPIFESHLNKIVAKSRSKALKKNPNLTEE
ELENIPYPKYSLVKALFLTFKVKYSLAIIFKALADIAQTLNPLLTKALINYVEERVKPSTP
LGKGIGYAFGVAFVLLANGILINHFLHNSLTTGAHCKAILTTALLKKSFNADAKTRHTY
NAGKVTSLMGTDLARIDLAVGFQPFAITFPLPVIIAIVLLIVNIGVSALAGIAIFIISIAIIGAS
AKRLLLMRKSANQYTDKRIGFMREILQSMKIIKFYSWEDAYQKNVTEQRNKEVSIIFKM
QTIRNFLMAYSVTLPTFTSMVAFLVLYGVKNDRNPANIFSSLSLFSALANQVLMLPMAL
ATGADAMIGIGRVREYLQCPDGKPLENNEDFDNNDGSQMINEKLAIKVKNASFEWEEFP
EVEEIKPIGKEKKGLRSRFQKKKKVDELDEKSNVILETSTSTDQSLKTNDQEINSDPETTA
AYTKNVFKGFHDINFEIKKGEFIIVTGPIGSGKSSLLTALSGFMKKTQGNLGINGSLLLCG
QSWVQNATVRENILFGLEFDEVRYRQVLKVCALTDDLKSFTGGELTEIGERGITLSGGQ
KARINLARAVYANKDVLLLDDVLSAVDARVGKHIMDNCLVDYLHGKTRILATHQLSLV
NDADRIIYLNGDGTINMGTVDELLATTPGFVTLMEYSKKSQDEENSEDDDDGKPEVIGE
ADVTLQATKSNTVSEKAGNAETGALIKAEEKAVNQTSWKVYLTYLKAGNGIFGIFASPL

| Illustrative Sequences |
|---|
| AILSLVIEVFCGLFVNVWLSFWIEYKFKTRSDGFYIGIYVMFVFLYTGFSSCTFVLMGYIT
IFAAKVLNLRAMQKILHAPMSYIDTTPIGRIMNRFTKDTDALDNETGEQIRLFLHPTFSVG
GILIMCIIYLPWFAIAIPPLGVVFVCVTNYYQSSSREIKRLEAVKRSFVYNNFNEVLGGMN
TIKAYNASDRFILKNSELLDNMNEAYFLVIANQRWISIHLDAVACVLSLIVSLLSVSRQFN
ISPASAGLVVTYTLNMAGLLSLILRAYTQVENEMNSVERLCHYANDLDQENAYRKPET
QPSSNWPEFGSLKFQNVSLRYRDGLPLVLKNLNVNIKGGEKIGICGRTGAGKSSIMTALY
RLSELAEGDIIIDDINIKQLGLYELRSKLSIIPQDPVLFQGSIRKNLDPFDEHDEDKLWDAL
RRSGLIEDEQVLEVIKKQDKLDENFHKFHLNQQVEDEGANFSLGERQLLALARALVRDS
KILILDEATSSVDYETDAKIQTTIANEFKDCTILCIAHRLKTILGYDRILVLEQEIEQFDEP
VTLFNEVDGIFRQMCDRSDIKSSDFLKDSYVYNSS SEQ ID NO: 48 Kuraishia capsulate ABC transporter polypeptide sequence
MSEPPRQKRILSWALSKKVPPITQEEDRLEYPFKRANILSKIFFSWLDPLLHKGYRRTLEP
EDLWYLTDELKLEHYYSVFLAQFEPDLAARREAHLEAKCKARGETFETSTVTEDEDLA
DFVYPWPKFGLILLKTFFRQYVGACVLKTIGDLASTTAPLLQKALINYVTKRAKGLEPN
VGTGVGYAIGCALFVTLEGLMVNHYFYHAMVTGSQVKAILTKFMLEKSFRQTGRSRHD
FPTGKVNSIMGTDLARIDFAIGFLPFLFCFPVPAIVSIVLLIINIGPSSLVGIAIFFLALIALGS
TIKRLMFFRLRANKFTDGRVNLVKELLKNFKMIKYYSWEPSYVKNIEETRTAEMHNVFL
MQIMRNIMVAFAIALPTVCSMISFLVLYGINSSRSVADIFSSLTLFQVLAMQLIMVPLALA
SGSDALIGIRRVLEFVCSGDIDEEDSQVELSLIKEKMESSGSVLRVVNASFEWETFDADEE
DIASTNESVSENERKPDPSLEGLESTSFPGLNNINLDIRKGEFVVVTGLIGSGKSSLLYALS
GFMHRTQGHVATIGDLLLCGNPWIQNATVKDNISFGMPFDQQKYDNVIHACSLEADLD
LLPAGDHTEVGERGITLSGGQKARLNLARAVYADRDIILLDDILSAVDARVGKHIMDEC
LLGLLKDKTRLLATHQLSLISAADRVIFLNGDGSIDVGTTAELLARNEGFTKLMEFSTQE
KNDTTTESGEAAHSGPELEDEKELIRIQTLTKSLAEAESNSDYQHKDADGVLMQLEDRA
VNAIELGVYGKYLKLGAGAFGIGIIPLLLGLVACSVFCSLFTNTWLTFWTEKKFDRSNGF
FIGIYVMFTMLTIVFMVLEFSLLVYLTNTASRLLNIYAIRRLMHVPMSFMDTTPMGRILN
RFTKDTDVLDNELPEQIRLLVHFTGTITGILVLCIIYLPWFAISVPILAFCYIACASYYQAS
AREVKRIEALQRSFVYSNFNETLQGMEVITAYKAEKRFIARNDALIDKMNEAYYLTFAN
MRWLSIRIDVLAAVLVLIVSLLCVMRVFHISPASVGLLLSYTLNIAGMMSMLLNVSTQIE
NEMNSVERLEYYGFRVVQEAPFKISEKTPPPEWPHDGRIQFENVTLCYRQGLPAVLKNL
NMDVKGAEKIGICGRTGAGKSSIMTALYRLAEMESGGRILIDDIDISTLGLHDLRSRLSIIP
QDPVLFRGSIRGNLDPFHEHKDELLWDALRRSGLIEGSKLDQVKHQTLDDENLHKFHLG
QNVEDDGTNFSLGERQLLALARALVRNSKILILDEATSSVDYETDSKIQTTISTEFAGCTI
MCIAHRLKTIVNYDRILVLDKGEISEFDKPWALFQDESTIFRQMCNKSGVVAEDFEKQN SEQ ID NO: 49 Saccharomyces cerevisiae ABC transporter polypeptide sequence
MTSPGSEKCTPRSDEDLERSEPQLQRRLLTPFLLSKKVPPIPKEDERKPYPYLKTNPLSQIL
FWWLNPLLRVGYKRTLDPNDFYYLEHSQDIETTYSNYEMHLARILEKDRAKARAKDPT
LTDEDLKNREYPKNAVIKALFLTFKWKYLWSIFLKLLSDIVLVLNPLLSKALINFVDEKM
YNPDMSVGRGVGYAIGVTFMLGTSGILINHFLYLSLTVGAHCKAVLTTAIMNKSFRASA
KSKHEYPSGRVTSLMSTDLARIDLAIGFQPPFAITVPVPIGVAIALLIVNIGVSALAGIAVFL
VCIVVISASSKSLLKMRKGANQYTDARISYMREILQNMRIIKFYSWEDAYEKSVVTERNS
EMSIILKMQSIRNFLLALSLSLPAIISMVAFLVLYGVSNDKNPGNIFSSISLFSVLAQQTMM
LPMALATGADAKIGLERLRQYLQSGDIEKEYEDHEKPGDRDVVLPDNVAVELNNASFI
WEKFDDADDNDGNSEKTKEVVVTSKSSLTDSSHIDKSTDSADGEYIKSVFEGFNNINLTI
KKGEFVIITGPIGSGKSSLLVALAGFMKKTSGTLGVNGTMLLCGQPWVQNCTVRDNILF
GLEYDEARYDRVVEVCALGDDLKMFTAGDQTEIGERGITLSGGQKARINLARAVYANK
DIILLDDVLSAVDARVGKLIVDDCLTSFLGDKTRILATHQLSLIEAADRVIYLNGDGTIHI
GTVQELLESNEGFLKLMEFSRKSESEEEEDVEAANEKDVSLQKAVSVVQEQDAHAGVLI
GQEERAVNGIEWDIYKEYLHEGRGKLGIFAIPTIIMLLVLDVFTSIFVNVWLSFWISHKFK
ARSDGFYIGLYVMFVILSVIWITAEFVVMGYFSSTAARRLNLKAMKRVLHTPMHFLDVT
PMGRILNRFTKDTDVLDNEIGEQARMFLHPAAYVIGVLILCIIYIPWFAIAIPPLAILFTFIT
NFYIASSREVKRIEAIQRSLVYNNFNEVLNGLQTLKAYNATSRFMEKNKRLLNRMNEAY
LLVIANQRWISVNLDLVSCCFVFLISMLSVFRVFDINASSVGLVVTSVLQIGGLMSLIMRA
YTTVENEMNSVERLCHYANKLEQEAPYIMNETKPRPTWPEHGAIEFKHASMRYREGLP
LVLKDLTISVKGGEKIGICGRTGAGKSTIMNALYRLTELAEGSITIDGVEISQLGLYDLRS
KLAIIPQDPVLFRGTIRKNLDPFGQNDDETLWDALRRSGLVEGSILNTIKSQSKDDPNFHK
FHLDQTVEDEGANFSLGERQLIALARALVRNSKILILDEATSSVDYETDSKIQKTISTEFS
HCTILCIAHRLKTILTYDRILVLEKGEVEEFDTPRVLYSKNGVFRQMCERSEITSADFV SEQ ID NO: 50 Cyberlindnera jadinii ABC transporter polypeptide sequence
MASPGSEKCTPRSDEDLERSEPQLQRRLLTPFLLSKKVPPIPKEDERKPYPYLKTNPLSQI
LFWWLNPLLRVGYKRTLDPNDFYYLEHSQDIETTYSNYEMHLARILEKDRAKAREKDP
TLTDEDLKNREYPKNAVIKALFLTFKWKYLWSIFLKLLSDIVLVLNPLLSKALINFVDEK
MYNPDMSVGRGVGYAIGVTFMLGTSGILINHPLYLSLTVGAHCKAVLTTAIMNKSFRAS
AKSKHEYPSGRVTSLMSTDLARIDLAIGFQPPFAITVPVPIGVAIALLIVNIGVSALAGIAVF
LVCIVVISASSKSLLKMRKGANQYTDARISYMREILQNMRIIKFYSWEDAYEKSVVTERN
SEMSIILKMQSIRNFLLALSLSLPAIISMVAFLVLYGVSNDKNPGNIFSSISLFSVLAQQTM
MLPMALATGADAKIGLERLRQYLQSGDIEKEYEDHEKPGDRDVVLPDNVAVELNNASF
IWEKFDDADDNDGNSEKTKEVVVTSKSSLTDSSHIDKSTDSADGEYIKSVFEGFSDINLTI
KKGEFVIITGPIGSGKSSLLVALAGFMKKTTGTLGVNGTMLLCGQPWVQNCTVRDNILF
GLEYDKDRYDRVVEVCALGDDLKMFTAGDQTEIGERGITLSGGQKARINLARAVYANK
DIILLDDVLSAVDARVGKLIVDDCLTSFLGDKTRILATHQLSLIEAADRVIYLNGDGTIHI
GTVQELLESNEGFLKLMKFSKKSESEEEENVEAANEKDVSLQKAVSVVQEQDAHAGVL
IGQEERAVNGIEWDIYKEYLHEGRGKLGIFAIPTIIMLLVLDVFTSIFVNVWLSFWISHKF
KARSDGFYIGLYVMFVILSVIWITAEFVVMGYFSSTAARRLNLKAMKRVLHTPMHFLDV |

-continued

Illustrative Sequences

TPMGRILNRFTKDTDVLDNEIGEQARMFLHPAAYVIGVLILCIIYIPWFAIAIPPLAILFTFI
TNFYIASSREVKRIEAIQRSLVYNNFNEVLNGLQTLKAYNATSRFMEKNKRLLNRMNEA
YLLVIANQRWISVNLDLVSCCFVFLISMLSVFRVFDINASSVGLVVTSVLQIGGLMSLIMR
AYTTVENEMNSVERLCHYANKLEQEAPYIMNETKPRPTWPEHGAIEFKHASMRYREGL
PLVLKDLTISVKGGEKIGICGRTGAGKSTIMNALYRLTELAEGSITIDDVEISQLGLYDLR
SKLAIIPQDPVLFRGTIRKNLDPFGQNDDETLWDALRRSGLVEGSILNTIKSQSKDDPNFH
KFPHLDQTVEDEGANFSLGERQLIALARALVRNSKILILDEATSSVDYETDSKIQKTISTEF
SHCTILCIAHRLKTILTYDRILVLEKGEVEEFDTPRELYSKNGVFRQMCERSEINSADFV

SEQ ID NO: 51 *Cryptococcus albidus* ABC transporter polypeptide sequence
MSQSDQLPDQLEVENQPIIKNEKRLLSWMLSKKVPSVPSQDERTLYPLHRTNIISRIMFW
WLFPVLNKGYKRTLVAEDLWIVDKDLTIEDMSTKFYNNLNRRIDAAKLKFENKPNKED
DEKFQWPKLIIVSSLFETFKVQYLLAILYLALSSVVQSLTPLLTKKLISFVEGRVLGTETTS
NKGIGYSFGAFCLVFLNGLFTNHFFHNSMLTGAQIKSVLTKSLLDKSFRLNAKAKHDFPT
GKITSLMGTDLARIDLAIGFQPFICCCFPISMIISIALLIHNIGVSALAGIGVFVISILLITASTK
ALFKIRKSVNFFTDKRVGLMREVLTSIKVIKFYAWEDAYKDNIADVREKEMASLFKIKII
RNFITAFAISLPTLTSMVAFCVMYAVKRGQNPADIFSSVSLFSVLSQAIFLVPVALATGAD
AYAGLDRVRLYLSSGEESSDDDLSMTETASTEEEKETEIAIKVSHASFKWEQFYDNEEEN
EKTANDKNEGTESKAAKKARKLAKDKKKEQMKEITKTKSHISNQLPAIESESFAGLTDL
DPTIEKNEFIIITGLIGSGKSSLLSALAGFMPRQSGFVESNGSILLCGYPWVQNATVKENIL
FGQPFDEEKYKSVIYACALEADLDILPAGDRTEIGERGITLSGGQKARINLARAVYNDQD
IILMDDVLSAVDARVGKHIMDHCFMGLLKEKTRILATHQLSLIGSADRIIFLNGDGSMN
MGTAEELAGSSSNFLKLMEFNSKSNDDEEESDGDVEDEILKDSKIVTVNEEEIRTKYGDK
TKSGILMTTEEKAVNSIPWSIYKTYINLGSGFFKFSATPIFLLLVILSTFCQLFTNVWLSFW
TEKKFHGYSDGFYIGLYIMFTFLTVFFLTGFFSMLAYTTNKAAERLNLMAVQKMVHAP
MGFMDTTPMGRILNRFKDTDSLDNEIAEQLRLLFYPLSTIIGVIILCIIYLPWFAIAVPFLV
GLFIVISNYYQASSREVKRLEAIQRSFVYNNFNEVLNGMSTIKAYSAQQFFIQKSDGLINR
MNEAYFITIANQRWISIHLDLIASIFALIIALLCVTRTFSISAASTGVLLSYVLQIVGLMSLFI
RALTQVENEMNSVERLCHYAQDLPQEAPYRINERQPSPEWPMNGELEFEDVSLSYRPGL
PLVLKDLTFGIKAGEKIGICGRTGAGKSSIMTALYRLSELTKGKIIIDGIDISTLGLYDLRS
KLSIIPQDPVLFQGTVRKNLDPFSEHSDDSLWDTLRRSGLIEESQLAQVSRSTKNENNTYE
DLHKFHLDQLVEDEGANFSLGERQLLALARALVRNSKILILDEATSSVDYETDSKIQSTI
VNEFSHCTILCIAHRLKTILNYDRILVLDKGEIEELDTPINLFNKKDGIFRQMCERSNIMEQ
DFGSSF SEQ ID NO: 52 *Candida haemulonii* ABC transporter polypeptide sequence
MDQRRQKRLLTPFLSKKVPPVPYDDERIVYPKRPNIFSAIFFWWLHPVMSTGYKRTLDT
ADLYKLNDENEVEAMTARFEGIFERRLHDARQKHIAAKCKARGETIENSSVPAEEDLEG
YQPPKLLCAWAILETFKWQYGLACLYNTLANTAAVTNPLLSKKLIQFVERHAMGLDTQ
TGKGVGYALGASFMVLIIGILINHGFQNAMLTGAQVKGVLTKAFLDKSFRLSDRARHDY
PASKITSMMGTDLARIDFALGFQPFLVSFPIPIAVAIGILIWNIGAPALVGIGLVFLFLGFIM
VFTGKLFAYRKKANKYTDARVNYIKEVLNNLKIIKYYSWEEPYNDVIGENRAKEMNIIY
KMQVGRNVILSSAMCLTLFASMASFLVLYATSGSTKDPASLFSSISLFNSMAQQVIMLPL
ALATGSDAAVGIMRAAQFLAAEEVDANATAIYAPPETRDQMEKDGLSISIKNASFEWES
FDNSSDDDEDEVKPKNDLEITEKGEAKENQGQSDDKSSSSTNTMKESDAEPKLTTYSTG
SSTMEATIFTGLSNIDLSVQKGEFIVITGLIGSGKTSLLNALAGFMKRVAGHVDVNGSLLL
CENPWIQNTTVRENILFGEEFDQDTYDSVLYACSLESDLEILPAGDQTEIGERGINLSGGQ
KARINLARAVYANKDIVLLDDVLSAVDARVGKHIMNNCLLGLLKDKTRILATHQLSLIG
AADRVVFLNGDGTVDVGTLEDLRKTNAGFEHLMKFSSESADDDEEETSPEEALGEDPEI
EEREMIERQLSQKQSTIPDEEAERHDYNVNEKQDGRLMSQENRAVNRIKGVVYKRYIK
YGSGIFKYYTGVPIIITLTIVAVFCQLFTNTWLTFWSDFKFDGKDNGFYIGFYVMFTVLAF
IFLSSEFIIVAYMTNEAAKVLNLKAVSRVLRAPMSFMDTTPMGRILNRFTKDTDTLDNEI
GNQIRMLIYFLSNIIGVIVLCVIYLPWFAIAIPFLGAIFVSVGNFYQASAREIKRLEATQRSF
VYNNFNETLSGMNTIKAYKAQTRFRKKNSTFIDNMNEAYYLTIANQRWLAIHLDLIAML
FAIIICFLCIFRVFDIGPAATGLLLSYVLQIAGQLSMLVRTYTQVENEMNAVERICEYAFH
LEQEAPYTYENSVLPPSWPEEGGIRFINASLAYREGLPNVLKSLNMDINPLEKIGICGRTG
AGKSSIMTALYRLAELNEGSIEIDGVDIGSIGLRDLRSKLSIIPQDPVLFRGSIRKNLDPFGA
SPDDVLWDAMRRAGLIEASKLSTIRNQSKSSENLFKFHLDREVEDNGSNFSLGERQLISF
ARALVRGSKILILDEATSSVDYETDSKIQETIKREFNDCTILCIAHRLKTIVNYDRILVLDK
GEIKEFDTPWNLFNSKHSIFQQMCEKSNITKEDFVARDR SEQ ID NO: 53 *Debaryomyces fabryi* ABC transporter polypeptide sequence
MSHIYSSNASIDGEGPVNSPPYDSYLNKYNNTNLLQVTTNNSETTTTFVDNSITSRLAEN
NKKSPNATPGNENNNSSSNLNLEGQEILHNEKRLFSFLFSKKVPPVTAPEERTIYPWKKA
NVFSRMMFYWLWPVLYKGYKRTLLPDDLWYLTEELKVESMHERFDVNLNKRLEKDK
QKYLKKHNNLDGHVWSPYNIPLALFDTFKLQYSMSCIFLGLSFVCQALSPLITRRLIDFV
QNSYETRIFGVEVSYNEGIGYTIGAVVLIFVNGLLLNHFFHNAMVTGAQAKAILTKSLLL
KSFSLSSKSRNQFSIGKITSLMSTDLARIDLAIGFQPLVVCFPIPVIIAVVLLLKFIGVTSLAG
IGLFVVSLVLCVLLTKKLFTTREEVVLYTDERISLMREVLTNLKIIKFYAWEMAYKVGIT
KVRTKEMKYLFTIKVLRNFVTAYAVTLPTLTSMVSFTSMWANNSMKGAGKVFSSLSLF
SILAQAIMLLPIALATGADALIGFRRCRDYLVAEEYDDDLEERLASDVDKRYIAGDTNSE
FEFKHESFDLSETGSYENTNKNANVIEVSHANFIWESFYTENSSSWDLNSSGSLSEKDPK
QKKKSKSKDIKYQIKEKDSFQESSRSSNETYCESPSVIEARNFPGLTDINLSVKQGEFIIITG
SIGSGKSSLLAALSGFMKLENPSVGKVSIYDDLLLCSDPWIQNATVRDNIIFGKPYDETRY
NKVIRACCLEDDIKLLPARDLAEIGERGITLSGGQKSRINLARAAYADAGILLFDDVLSA
VDARVGKHIVNNLFNGLLKDKTKVLATHQLSLIESADKVVYLNGDGSIDFGTLNELLAR
NNQFKRLIEFNTDLTRDNESRKSETQRVYENYSDTDYDNNNGYEGARLIRQQSVVPESS Illustrative Sequences DIAGKIMGDEERATNAISWDIYKKYIDLGSGFFGWSAGPVFIFLISLATFCQLFTNTWLSF
WTEKKFPNKSDHFYVALYVMFAFLTVFFTAIEFTMLAYMNNRSAKLLNVKAVEKILHA
PMSYLDTNPMGRILNRFTKDTDSLDNEIGEQLRLFLFPLATIIGIVILCICYLPWFAIAVPFL
SFAFVFVANFYQGSSREIKRLEAVQRSLVYNNFNETLSGMSTIKAYKVEETFIEKNDRYL
NKMNEAYYVSIANQRWLGVHLDIIASIFALIICLLCITDQFHISASSTGLLLSYVIQIVGLLS
LTIRSMTQVENEMNSVERLHQYAFHLPQEGAYKKPESKPPAEWPPSGYIQFNNVSLKYR
DHLPTVLKNLNFSVYPGEKVGICGRTGAGKSSIMSALYRLVELNEGSIIIDGLNIAEMGL
YDLRSKLSIIPQDPVLFQGTIRRNLDPFNESTDEKLWDALRRSGLIDASQISKIKNTKLDQ
NRNIGHDSLHKFHLDQLVADDGSNFSLGERQLIALARAMVRNSKILILDEATSSVDYETD
AKIQETIVNEFSHCTILCIAHRLKTILHYDRILVMDKGSLIEKGTPYNLFTDRNGVFRQMC
DKTNIIDEDFQ SEQ ID NO: 54 Spathaspora passalidarum ABC transporter polypeptide sequence
MSEDPHFLQQKRLLTFMLSKKVPPIPTEEERDPYPVKKANIISRILFWWLGPVMHTGYRR
TLQPEDLFYLTDDIKVQTMADRFYNYMTNDIERARQQHIAEKCKERGETPETSSVDRGK
DLADFELSKFLTVWALAKTYKWQYTWACTLLCLSSVGQTTLPLLTKLIRYVELKSMG
VETGIGRGIGYSFGSAIIIFIIGVLINHFFYRSMLTGAQAKAVLTKALLDKSFKLNAAARH
KYPVGKITSMLGTDLSRIDFALGFQPFLICFPVPIGIAIGILIWNIGVAALVGVAILLVFMV
CIAVSTGALFKYRKKANKYTDSRVDHIKEALNNLKIIKFYSWEPPYHENISEIRRKEMKII
YRMQVLRNVVTSFAFSLTLFASMTAFLVLYAIAANRKDPASIFSSLSLYNILTQQVFLLP
MALATGADAFMGISRVGEFMSQGEIDPALSNIDATPEKKLLMENDETAIEVDHASFEWE
VFGNDEDDEEESESKKGEKKSMEKKVHKTEVHYHEKTGSIEKDSLTTSSSGRGEEESQF
PGLKDINFKIKKGEFVVITGLIGSGKTSLLNAISGFMKRVHGDVSTNGSLLLCGYPWVQN
STVKENILFGEPYDEKKYKQVIYACSLEADLEILPAGDRTEIGERGITLSGGQKARINLAR
AVYANRDIILLDDDVLSAVDARVGKHIMNNCIMDLLKDKTRILATHQLSLIGSADRVIFLN
GDGSVDVGTFEELSSSNPGFSKLMTFNSEAHNDEEEEEDVPESEDELEQEREMIKRQLTR
LSTRASTKADPEDEEARHREFNTDESADGKLIDEEERAVNAISMRVYGRYIELGSGAVG
PYVYGPLLLIFLMFATFCSIFTNTWLSFWVERRFPLEDKVYIGVYIMFTFLAFIFLTIEFILL
VYLTNTASVKLNILAMKKVLHAPMSFMDTTPLGRILNRFTKDTDVLDNEIGDQLRFFLF
TLSNIIGVLILCIIYLPWFAISIPFLGFLFVAIANYYQASAREIKRLEAIQRSFVYNNFNETLS
GMTTIKAYHAVPRFLEKNNFLIDRMNEAYYLTIANQRWLAIHMDMVASLFALLIALLCV
NRVFRISAASVGLIVAYVFQIAGQLSMLIRTFTQVENEMNSVERLDSYASNLPEEAPYVIT
EKTPPPQWPDKGSIEFRSASLAYRPGLPLVLKNLNFTIKPSEKIGICGRTGAGKSSIMTAL
YRLSELESGKIFIDDLDIAELGLKDLRSKLSIIPQDPVLFRGTIRKNLDPFNQSSDDKLWDA
LRRTGLIEEGRLEQVKLTNKPSDGSSETNLHKFHLDQSVEDEGTNFSLGERQLIAFARAL
VRDSKILILDEATSSVDYETDSKIQHTIIREFSHCTILCIAHRLKTIINYDRILVLDKGEIREF
DTPWNLFKSNGSIFQQMCQRSNITDQDFENITSF SEQ ID NO: 55 Hansenula polymorpha ABC transporter polypeptide sequence
MSLELSNSTLCDSYWAVDDFTACGRQLVESWVSVPLVLSALVVAFNLLRNSLASEKTD
PYSKLDAEQQPLLQNGHALYTSSIESDNTDIFQRHFDIALLKPVKDDGKPIGVVRIVYRD
TAEKLKVALEEILLISQTVLAFLALSRLEDISESRFLLVKYINFSLWLYLTVITSARLLNVT
KGFSANRVDLWYHCAILYNLQWFNSVMLFRSALLHHVSGTYGYWFYVTQFVINTLLCL
TNGLEKLSDKPAIVYEEEGVIPSPETTSSLIDIMTYGYLDKMVFSSYWKPITMEEVWGLR
YDDYSHDVLIRPFHKLKSSIRFTLRLFLQFKKELALQTLCTCIEALLIFVPPLCLKKILEYIES
PHTKSRSMAWFYVLIMFGSGVIACSFSGRGLFLGRRICTRMRSILIGEIYSKALRRRLGST
DKEKTTEEEDDKSAKSKKEDEPSNKELGGIINLMAVDAFKVSEIGGYLHYFPNSFVMAA
VAIYMLYKLLGWSSLIGTATLIAILPINYMLVEKLSKYQKQMLLVTDKRIQKTNEAFQNI
RIIKYFAWEDKFADTIMKIREEELGYLVGRCVVWALLIFLWLVVPTIVTLITFYAYTVIQG
NPLTSPIAFTALSLFTLLRGPLDALADMLSMVMQCKVSLDRVEDFLNEPETTKYQQLSA
PRGPNSPLIGFENATFYWSKNSKAEFALKDLNIDFKVGKLNVVIGPTGSGKSSLLLALLG
EMDLDKGNVFLPGAIPRDDLTPNPVTGLMESVAYCSQTAWLLNATVKDNIIFASPFNQE
RYDAVIHACGLTRDLSILEAGDETEIGEKGITLSGGQKQRVSLARALYSSASYLLLDDCL
SAVDSHTAVHIYDYCINGELMKGRTCILVSHNVSLTVKEADFVVMMDNGRIKAQGSVD
ELMQEGLLNEEVVKSVMQSRSASTANLAALDDNSPISSEAIAEGLAKKTQKPEQSKKSK
LIEDETKSDGSVKPEIYYAYFRYFGNPALWIMIAFLFIGSQSVNVYQSYWLRRWSAIEDK
RDLSAFSNSNDMTLFLFPTPHSINWHRPLVNYALQPFGLAVEEERSTMYYITIYTLIGLAFA
TLGSSRVILTFIGGLNVSRKIFKDLLDKLLHAKLRFFDQTPIGRIMNRFSKDIEAIDQELAL
YAEEFVTYLISCLSTLVVVCAVTPAFLVAGVLILLVYYGVGVLYLELSRDLKRFESITKSP
IHQHFSETLVGMTTIRAYGDERRFLKQNFEKIDVNNRPFWYVWVNNRWLAYRSDMIGA
FIIFFAAAFAVAYSDKIDAGLAGISLSFSVSFRYTAVWVVRMYAYVEMSMNSVERVQEY
IEQTPQEPPKYLPQDPVNSWPSNGVIDVQNICIRYSPELPRVIDNVSFHVNAGEKIGVVGR
TGAGKSTIITSFFRFVDLESGSIKIDGLDISKIGLKPLRKGLTIIPQDPTLFSGTIRSNLDIFGE
YGDLQMFEALRRVNLISVDDYQRIVDGNGAAVADETAQARGDNVNKFLDLDSTVSEG
GGNLSQGERQLLCLARSILKMPKILMLDEATASIDYESDAKIQATIREEFSSSTVLTIAHR
LKTIIDYDKILLLDHGKVKEYDHPYKLITNKKSDFRKMCQDTGEFDDLVNLAKQAYRK SEQ ID NO: 56 Kluyveromyces lactis ABC transporter polypeptide sequence
MSGSNSNSNLDAISDSCPFWRYDDITECGRVQYINYYLPITLVGVSLLYLFKNAIQHYYR
KPQEIKPSVASELLGSNLTDLPNENKPLLSESTQALYTNPDSNKTGFSLKEEHFSINKVTL
TEIHSNKHDAVKIVRRNWLEKLRVFLEWVLCALQLCIYISVWSKYTNTQEDFPMHASIS
GLMLWSLLLLVVSLRLANINQNISWINSGPGNLWALSFACYLSLFCGSVLPLRSIYIGHIT
DEIASTFYKLQFYLSLTLFLLLFTSQAGNRFAIIYKSTPDITPSPEPIVSIASYITWAWVDKF
LWKAHQNYIEMKDVWGLMVEDYSILVIKRFNHFVQNKTKSRTFSFNLIHFFMKFIAIQG
AWATISSVISFVPTMLLRRILEYVEDQSTAPLNLAWMYIFLMFLARILTAICAAQALFLGR
RVCIRMKAIIISEIYSKALRRKISPNSTKEPTDVVDPQELNDKQHVDGDEESATTANLGAII
NLMAVDAFKVSEICAYLHSFIEAIIMTIVALFLLYRLIGWSALVGSAMIICFLPLNFKLASL

| Illustrative Sequences |
|---|
| LGTLQKKSLAITDKRIQKLNEAFQAIRIIKFFSWEENFEKDIQNTRDEELNMLLKRSIVWA
LSSLVWFITPSIVTSASFAVYIYVQGQTLTTPVAFTALSLFALLRNPLDMLSDMLSFVIQS
KVSLDRVQEFLNEEETKKYEQLTVSRNKLGLQNATFTWDKNNQDFKLKNLTIDFKIGKL
NVIVGPTGSGKTSLLMGLLGEMELLNGKVFVPSLNPREELVVEADGMTNSIAYCSQAA
WLLNDTVRNNILFNAPYNENRYNAVISACGLKRDFEILSAGDQTEIGEKGITLSGGQKQR
VSLARSLYSSSRHLLLDDCLSAVDSHTALWIYENCITGPLMEGRTCVLVSHNVALTLKN
ADWVIIMENGRVKEQGEPVELLQKGSLGDDSMVKSSILSRTASSVNISETNSKISSGPKA
PAESDNANEESTTCGDRSKSSGKLIAEETKSNGVVSLDVYKWYAVFFGGWKMISFLCFI
FLFAQMISISQAWWLRAWASNNTLKVFSNLGLQTMRPFALSLQGKEASPVTLSAVFPNG
SLTTATEPNHSNAYYLSIYLGIGVFQALCSSSKAIINFVAGIRASRKIFNLLLKNVLYAKLR
FFDSTPIGRIMNRFSKDIESIDQELTPYMEGAFGSLIQCVSTIIVIAYITPQFLIVAAIVMLLF
YFVAYFYMSGARELKRLESMSRSPIHQHFSETLVGITTIRAFSDERRFLVDNMKKIDDNN
RPFFYLWVCNRWLSYRIELIGALIVLAAGSFILLNIKSIDSGLAGISLGFAIQFTDGALWVV
RLYSNVEMNMNSVERLKEYTTIEQEPSNVGALVPPCEWPQNGKIEVKDLSLRYAAGLP
KVIKNVTFTVDSKCKVGIVGRTGAGKSTIITALFRFLDPETGYIKIDDVDITTIGLKRLRQS
ITIIPQDPTLFTGTLKTNLDPYNEYSEAEIFEALKRVNLVSSEELGNPSTSDSTSVHSANMN
KFLDLENEVSEGGSNLSQGQRQLICLARSLLRCPKVILLDEATASIDYNSDSKIQATIREEF
SNSTILTIAHRLRSIIDYDKILVMDAGEVKEYDHPYSLLLNRDSIFYHMCEDSGELEVLIQ
LAKESFVKKLNAN SEQ ID NO: 57 *Saccharomyces cerevisiae* ABC transporter polypeptide sequence
MSSTDEHIEKDISSRSNHDDDYANSVQSYAASEGQVDNEDLAATSQLSRHLSNILSNEEG
IERLESMARVISHKTKKEMDSFEINDLDFDLRSLLHYLRSRQLEQGIEPGDSGIAFKNLTA
VGVDASAAYGPSVEEMFRNIASIPAHLISKFTKKSDVPLRNIIQNCTGVVSGEMLFVVG
RPGAGCSTFLKCLSGETSELVDVQGEFSYDGLDQSEMMSKYKGYVIYCPELDFHFPKIT
VKETIDFALCKTPRVRIDKMTRKQYVDNIRDMWCTVFGLRHTYATKVGNDFVRGVS
GGERKRVSLVEAQAMNASIYSWDNATRGLDASTALEFAQAIRTATNMVNNSAIVAIYQ
AGENIYELFDKTTVLYNGRQIYFGPADKAVGYFQRMGWVKPNRMTSAEFLTSVTVDFE
NRTLDIKPGYEDKVPKSSSEFEEYWLNSEDYQELLRTYDDYQSRHPVNETRDRLDVAK
KQRLQQGQRENSQYVVNYWTQVYYCMIRGFQRVKGDSTYTKVYLSSFLIKALIIGSMF
HKIDDKSQSTTAGAYSRGGMLFYVLLFASVTSLAEIGNSFSSRPVIVKHKSYSMYHLSAE
SLQEIITEFPTKFVAIVILCLITYWIPFMKYEAGAFFQYILYLLTVQQCTSFIFKFVATMSKS
GVDAHAVGGLWVLMLCVYAGFVLPIGEMHHWIRWLHFINPLTYAFESLVSTEFHHREM
LCSALVPSGPGYEGISIANQVCDAAGAVKGNLYVSGDSYILHQYHFAYKHAWRNWGV
NIVWTFGYIVFNVILSEYLKPVEGGGDLLLYKRGHMPELGTENADARTASREEMMEAL
NGPNVDLEKVIAEKDVFTWNHLDYTIPYDGATRKLLSDVFGYVKPGKMTALMGESGA
GKTTLLNVLAQRINMGVITGDMLVNAKPLPASFNRSCGYVAQADNHMAELSVRESLRF
AAELRQQSSVPLEEKYEYVEKIITLLGMQNYAEALVGKTGRGLNVEQRKKLSIGVELVA
KPSLLLFLDEPTSGLDSQSAWSIVQFMRALADSGQSILCTIHQPSATLFEQFDRLLLLKKG
GKMVYFGDIGPNSETLLKYFERQSGMKCGVSENPAEYILNCIGAGATASVNSDWHDLW
LASPECAAARAEVEELHRTLPGRAVNDDPELATRFAASYMTQIKCVLRRTALQFWRSPV
YIRAKFFECVACALFVGLSYVGVNHSVGGAIEAFSSIFMLLLIALAMINQLHVFAYDSRE
LYEVREAASNTFHWSVLLLCHAAVENFWSTLCQFMCFICYWPAQFSGRASHAGFFFFF
YVLIFPLYFVTYGLWILYMSPDVPSASMINSNLFAAMLLFCGILQPREKMPAFWRRLMY
NVSPFTYVVQALVTPLVHNKKVVCNPHEYNIMDPPSGKTCGEFLSTYMDNNTGYLVNP
TATENCQYCPYTVQDQVVAKYNVKWDHRWRNFGFMWAYICFNIAAMLICYYVVRVK
VWSLKSVLNFKKWFNGPRKERHEKDTNIFQTVPGDENKITKK SEQ ID NO: 58 *Hansenula polymorpha* ABC transporter polypeptide sequence
MSEYHINGHFYEPSAIYDLQRVSTFWEQLVMDLTSSGFNNAIGLNNSTGSRCGCYDGEG
YKFSSDLQDPSPCLVSGVFASLVSLVFVIGGLVQVHKLRKTRNVNSKVEWWFVLKLSLI
AVQIFVQLTLATLAVRMSPSPLSDVLVLSSGLNFIALGVAFALSYIENFKTFVSEAALIIY
WLLYLFIGFLKIVNLGLRNDKSSRLPITVLSTVNNLILLVIEIYFAPKAPVDPTQTENLYDS
ANIFGKVTFTWLTPLMQKGSIKYLTQFDLPALPSFLKSDHLSGVLESHWAKQLRSKKPSL
AIALAKSFGGPFLVAALFKVVQDCCAFIQPQLLKQLIRFVNEYHEDPTIPLTKGFMIVAS
MFILSVLQTASLHQYFTRVFDTGIKVKSSLTSLIYKKSLVLSIEAKQKKSSGDIVNLMSVD
TQRLQDLCQNLNVIWSGPFQIILCLISLYNLLGNAMWLGVLFLCISVPMNTWVFGQQKK
LQKTQMKVKDERTGLISEMLNNIKSLKLYAWEIPYKKKLMYVRNNKELSNLRKIGIFQA
CSQFIFNTTPYLVSTSTFALFIVAYKGVPLSTDIVFTALSLFNLLGFPLAVLPWTIGNIIEAQ
VAISRITGFLESDELDTSTVTRLPAPTEIGQDVVNIVNADFLWSKDPYKAALENINFTAKK
GQLNCIIGRVGAGKTALLQSLLGDLHKPTGTVIVRGSVAYVPQTAWIMNGTIKENILFGC
KYDPDFYDKTIKACALTHDLNVLTDGDATQVGEKGISLSGGQKARLSLARAVYARADL
YLLDDILSAVDEHVGKHLINNVLGPDGLLSTKCRILATNNLNVLKFSDHISLLQNGKITES
GHYDDIISAQKSELYNVINDSGAKKKDDEVSEDVSETVIDKESSEDTQSVSSELDEDIKK
CASKDLPKAELEDFKAVVSRKNETLTGREEKHEQGKVKTAIYRAYAKACGVKNVIFFL
VTVILSMGASVLANIWLKHWSDINTRLGYNPQPWKYLGTYFGLCVASTFFLLCQTLVQ
WLAVSIQGSKYLHQIMLDGVLRAPMQFFETTPIGRILNRFSPDIYKIDEQLARVFAMFFT
NSIKVTFTMLVIIYSTWQFVFLVVPLAVLYRFYQLYYLATSRELRRLDSVSKSPIFAHQE
TLSGVATVRAYDQLERFMYMNQQKMDVNMSAYHPSVSANRWLAVRLEFLGSLIILGA
SSLLVATLRSGRVTPGLVGLSISYALQTTQSLNWIVRMTVEIETNIVSVERVLEYAALEPE
APAIIENKRPPSHWPSKGTINFKNYSTRYRPDLDLVLKNINLAIKEKEKIGIVGRTGAGKS
SLTLAIFRIIEAFEGHIEIDDLNTSEIGLFDLRSKLSIIPQDSQIFEGTLRANIDPIEQYSDDEI
WQALELSHLKDHVMVMYEESTNKEDIKMDPLLVRINEGGSNLSAGQRQLMCLARALV
KKESKVLILDEATANVDYQTDAIVQETIRSAFKERTILTIAHRLNTIIDSDRIIVLEKGEVA
EFDTPQNLLKKKDSLFYSLCKEGGLVE |

| Illustrative Sequences |
| --- |

SEQ ID NO: 59 *Pichia pastoris* ABC transporter polypeptide sequence
MNSLDFIADSVQHLFEQTSMNILPSSGLNSGSLQNESLPVTCSWGCFDEEGWGPMSPYS
DLTTCFINGALINFSSLFLVLVGGYQLVALRRSRTTNTNIDWTLPLKLVLISFQIILNVNLA
ANYFYESVDFKHDIKFVTPVFSSVALIVALFAHYVEVFKTSVPLGSLLFYWLFTFVSGCF
NLGNLIVRSNYANPTLVTTVFTIVIALILLILESAFPIRPASPAGYEIFYPLSPFDTAHVFSRI
TFQWMSGLMKKGHESFLGEDDLPPLPKYLTAKMTSEKFNYNWTHQLRTKKDQLSLTW
ALAKSFGAPFLVGGIFKACQDILAFTQPQLLRILIKFVNDYNDGNGTVPLTKGFMIVISMF
LVSIVQTGCLHQYFQRAFDMGMKIKTALTSSIYSKSLTLSNEEKSKYATGDIVNLMSVDT
QRLQDLVQNIQIIWSGPFQIILCLFSLHGLVGNSMWMGVVIMIIMIPLNGALAKYQKKLQ
KIQMKNKDQRTRIVSEILNNIKSLKLYGWESPYKERLTYVRNEKELKNLKKMGIFQAFS
TFTWSCAPFLVSCSTFAVFVLTNKNSPLTTDIVFPALALFNLLSFPLAVIPMVITSIVEAQV
AISRLTKFLTGSELQNDSVIRLPRSKKVGETVVRIKSGQFLWCREPYKVALKDVNFAAR
KGELSCIVGKVGAGKSSLIRSILGDLYKSEGTVIIRGSVAYVSQVPWIMNGSIKENILFGC
KYEPEFYKKTLEACALDTDLSILTDGGDATQVGEKGISLSGGQKARLSLARAVYARADVY
LMDDVLSAVDEHVGKHITTHVLGPSGLLSKCRILATNNINVLKHSSHVSLIQEGSIIEEG
NYQTVVSNSSSKLSVLIKEFSKAASSTDNSGTNSTAEVTPVPSQLGISKSVSDTVSLRRAS
LESFSKSTSNNLDEESKQKINKEHHEQGQVKFNVYKVYANACNPKAVCFLLFLIILAMFT
SVLGNIWLKHWSEVNTEYGGNPNIALYLGIYFALGIASSLLSLLKTAMQWIYCTISGSKY
LHKTMTDSVFRAPMEFFETTPIGRILNRFSSDIYKVDEILGRVFEQFFTNAVKVFFTVAVI
CYSTWQFIFMILPILMLYVYYQQYYLRTSRELRRLDSVSRSPIFAHFQETLTGTSTIRAYN
QLDRFRYMNQSKVDFNISAYHPAISANRWLAVRLEFLGSVIILGASGLSIFTLKSGGITAG
MVGLSVSYALQITQSLNWIVRMTVEVETNIVSVERIIEYSTLKSEAPAIIEDNRPPKDWPF
EGKIEFKNYSTRYREGLDLVLKDINVSINPKEKIGIVGRTGAGKSSLTLALFRIIEAAQGSI
WIDGIDTSKIGLEDLRHKLSIIPQDSQVFAGTLRENLDPTNQYSDDEIWKAIELAHLKPLV
ISMAEGDATGLEVRLAEGGSNLSVGQRQLICLARALLIKSHILVLDEATAAVDVETDQV
LQETIRKEFKDRTILTIAHRLNTIMDSDRIIVLDNGRIAEFDTPANLLKNKESLFYSLSSEG
GTIE SEQ ID NO: 60 *Saccharomyces cerevisiae* ABC transporter polypeptide sequence
MQAQGSQSNVGSLRSNCSDNSLPNNHVMMHCDESSGSPHSEHNDYSYEKTNLESTASN
SREHRDNQLSRLKSEEYVVPKNQRRGLLPQLAIIPEFKDARDYPPMMKKMIVFLIAFSSM
MGPMGTSIIFPAINSITTEFPKTSVIMVNVSIGVYLLSLGVFPLWWSSLSELEGRRTTYITSF
ALLFAFNIGSALAPDINSFIALRMLCGAASASVQSVGAGTVADLYISEDRGKNLSYYYLG
PLLAPLLSPIFGSLLVNRWPWRSTQWFMVILSGCNVILLTVLLPETLRKQDSKGAIAQILA
ERRIQVDNNERGEIQEDYQRGEDETDRIENQVATLSTEKHNYVGEVRDQDSLDLESHSS
PNTYDGRAGETQLQRIYTEASRSLYEYQLDDSGIDATTAQVTRIRSTDPKLARSIRENSLR
KLQTNLEEQVKKVLSSNGGEIAPKQVSAVRKVWDTFFVYFIKPLKSLHFLEYPPVALAIT
FSAISFSTVYFVNMTVEYKYSRPPYNFKPLYIGLLYIPNSVTYFFASIYGGRWVDMLLKR
YKEKYGILAPEARISWNVVTSVISFPIALLIFGWCLDKKCHWVTPLIGTALFGYAAMMTI
GATLSYLVDSLPGKGATGVALNNLIRQILAATAVFVTTPMLNGMGTGWAFTMLAFIVL
GASSVLIILKKHGDYWRENYDLQKLYDKID SEQ ID NO: 61 *Pichia pastoris* ABC transporter polypeptide sequence
MERDTHEADPAQPVLSHNNSSGDEVLSYRAEDEQAQLEGVNLDRLQSLTKQMSHVTAS
EMATMVDLNDFDLTRILAVFAEKAEQRGLPIKSTAVELKDVSVLGVNDSASLLPTVSDL
LYLPSTIARKIRNRKPALRHILKGVDFHTVPGEMCLVLGRPGAGCSSLLKTIAGETSHFV
RVEGDIAYNNIPQAEMVKRFKNELIYNPELDLHFPHLTVEETLSFALACKTPRIRIDDISR
KKHVDNWLKILLTVYGLGHTRNTIVGNDFVRGVSGGERKRVSIAEAMAANGTVYCWD
NATRGLDASTALEFTESVRATTNLEQTTSFVTLYQPSERIYELFDKVLVLYEGRQIYFGP
ADAAKQFFVDMGYDCPPRQTTGEFLTAVTDPLQRYPRPGFENRVPINADEFQEYWRAS
STYSDLQNFQETLKAGLSETTKETFLKAAANEKMKGVSDNSKYTVNYFEQLRLCIVR
GFQRIKGDINYTIVMVVSALIQGLVVGSLYWNTPENSSGVFGRAGVIFFAILFFVLMSLA
EIANIFKDRPVLAKQIGYSLYHPSTEVIANALIQIPVKFIASLFFSIVVYFLANMKRQPGPFF
AFLLFVNLGSQTMAALFNLVAAVSPTLAVANAFDGLLVLSSVLYTSYMIQRPSMVPWF
EWFSYMNPMLYAFESMLTNEFHGSIIDCSDVDLIPNGPGYEDYPDQYRSCAITGANGRT
YVDGDTYLDLSFEYSYSHIWRNMGILFLFYVAFLVIHSVMSEIMNMSTSTADRLIFLKAN
DLPVEVAAALNGSASSNDEETGQDTSLNEKYELERDKSEVKVSDKLLGSGDEVFTWKDV
NYVIPYQGSERTLLDHVQGYVKPGTLTALMGESGAGKTTLLNVLSQRIDVGVVTGDML
VNGNPVSASFKRRTGYVQQQDLHISELTVRESLIFAAKLRRPLSVPVAEKIQYVDQVIEIL
QMTKYKDAVAGELGAGLNVEQRKKLSIATELVSKPDLLLFLDEPTSGLDSQSSWAIVKL
LRQLADAGQAILCTIHQPSATLFEQFDRLLLLRKGGQTVYFGDIGENSSVITGYFERNGA
RKCSPAENPAEYILEVIGAGATASITENWFDVWIKSPESQEVSQEISTLVTRAGNSTSSVD
DAAHLGTFATPWHYQYQLVLQRTAQQFFRDMEYFMAKFMLLLSGGLLIGFSFWDVKH
TIVGMQNAMFAVFSAMILSAPLSNQIQSKAIASRELYEARESKSNTFHWSALLLSQFLVEI
PYSVVFSTIFYICWYPPVQLDNAPERAGVWWLHYCIFFQLYYISFALATVYFAPDLPTAN
VILSFLFNFIFAFCGVVQPVDMMPGFWTFMNKVSPYTYFVQSFLGNVLHGREVHCAAN
EMTYIQPPSEQSCGEYLTPFIEEHTGYVANPGAFEDCGFCKFAVGDQYLSTVGIKYSYG
WRNVGFYWVYIVFNLSAMLFLYYMFKVRKQSIFAPIIGLFGRKQKD SEQ ID NO: 62 *Pichia pastoris* ABC transporter polypeptide sequence
MNSYNESAPTGCSFWDNDDISPCIRKSLLDSYLPAAIVVGSLLYLLLIGAQQIKTHRKLY
AKDETQPLLEPANGSPTDYSNTYGTIDYEEEQSTAELTTSQKHFDISRLEPLKDDGTPLGL
VKYVQRDGWEKVKLILEFVILIFQLVIAVALFVPSLNQEWEGYKLTPIVRVFVWIFLFA
LGSIRALNKSGPFPLANISLLYYIVNIVPSALSFRSVLIHPQNSQLVNYYYSFQFINNTLLFL
LLGSARVFDHPSVLFDTDDGVKPSPENNSNFFEIVTYSWIDPLIFKAYKTPLQFNDIWGLR
IDDYAYFLLRRFKDLGFTRTFTYKIFYFSKGDLAAQALWASIDSMLIFGPSLLLKRILEYV

```
                       Illustrative Sequences
DNPGMTSRNMAWLYVLTMFFIQISDSLVSGRSLYLGRRVCIRMKALIIGEVYAKALRRR
MTSPEELIEEVDPKDGKAPIADQTSKEESKSTELGGIINLMAVDASKVSELCSYLHFFVNS
FFMIIVAVTLLYRLLGWSALAGSSSILILLPLNYKLASKIGEFQKEMLGITDNRIQKLNEAF
QSIRIIKFFAWEENFAKEIMKVRNEEIRYLRYRVIVWTCSAFVWFITPTLVTLISFYFYVVF
QGKILTTPVAFTALSLFNLLRSPLDQLSDMLSFMVQSKVSLDRVQKFLEEQESDKYEQLT
HTRGANSPEVGFENATLSWNKGSKNDFQLKDIDIAFKVGKLNVIIGPTGSGKTSLLLGLL
GEMQLTNGKIFLPGSTPRDELIPNPETGMTEAVAYCSQIAWLLNDTVKNNIVFAAPFNQ
QRYDAVIDACGLTRDLKVLDAGDATEIGEKGITLSGGQKQRVSLARALYSNARHVLLD
DCLSAVDSHTAAWIYENCITGPLMKDRTCILVSHNVALTVRDAAWIVAMDNGRVLEQG
TCEDLLSSGSLGHDDLVSTVISSRSQSSVNLKQLNVSDTSEIHQKLKKIAESDKADQLDE
ERLSPRGKLIEDETKSSGAVSWEVYKFYGRAFGGVFIWFVFVAAFAASQGSNIMQSVWL
KIWAAANDKLVSPAFTMSIDRSLNALKEGFRASVASVEWSRPLGGEMFRVYGEESSHSS
GYYITIYALIGLSYALISAFRVYVVFMGGIVASNKIFEDMLTKIFNAKLRFFDSTPIGRIMN
RFSKDTESIDQELAPYAEGFIVSVLQCGATILLICIITPGFIVFAAFIVIIYYYIGALYLASSR
ELKRYDSITVSPIHQHFSETLVGVTTIRAYGDERRFMRQNLEKIDNNNRSFFYLWVANR
WLALRVDFVGALVSLLSAAFVMLSIGHIDAGMAGLSLSYAIAFTQSALWVVRLYSVVE
MNMNSVERLEEYLNIDQEPDREIPDNKPPSSWPETGEIEVDDVSLRYAPSLPKVIKNVSF
KVEPRSKIGIVGRTGAGKSTIITAFFRFVDPESGSIKIDGIDITSIGLKDLRNAVTIIPQDPTL
FTGTIRSNLDPFNQYSDAEIFESLKRVNLVSTDEPTSGSSSDNIEDSNENVNKFLNLNNTV
SEGGSNLSQGQRQLTCLARSLLKSPKIILLDEATASIDYNTDSKIQTTIREEFSDSTILTIAH
RLRSIIDYDKILVMDAGRVVEYDDPYKLISDQNSLFYSMCSNSGELDTLVKLAKEAFIAK
RNKK SEQ ID NO: 63 Calathea utilis ABC transporter polypeptide sequence
MSSTEKSSEDSIDTNDGVNTYRGFDADVQEQVQDLARILTNKSYSSSCQNKADSDLLSR
VSTVAPGVDPITGLEQLDPRLDPNSSDFSSRYWIKNFRALMDKDPEHYNNYSLGITYKN
LRAYGEATDADYQSNVVNAPAKLFGGLYKKYFRTSSAKEKVQFDILKSMDGIIKPGEV
VVVLGRPGSGCTTLLKTIASNTHGFDIAPESEITYDGLTPQEVVKSFRGEIVYNAEADIHF
PHLTVWQTLYTAAKFRTPENRIPGVSREEFAAALTKVMATYGLTHTKNTRVGSELVR
GVSGGERKRVSIAEVSLAGSKLQCWDNATRGLDAATALEFIRALRTSADVLDTTALIAI
YQCSEAYDLFDKVSVLYEGYQIYFGRGDKAREYFIKMGWDCPQRQTTADFLTSVTSP
RERVARKGYESKVPKTGKEFEAYWKASPEYAELMKEIDANLHQTSQSSTKDVILSAKH
ARQSKNMRKSSPFTVSFPMQVRYLLTREFQRIRNDIFFHAFSVLSNSLMSLVLSSIFYNLQ
NDTASFYYRGAAMFLAVLFNSFASFLEIMSLFEARPIIEKHKQFALYHPAADALASVISQ
TPFKMITALFFNLVFYFMVNLRRDPGRFFFYFFVNILATFTMSHAFRLIGSMSNSLAQAL
VPAHIILLGLVMFLGFTLPTPYMLGWCRWMNYLNPLAYTFEALMANEFHDREFDCTQFI
PGNPNEHPEWPSAAWVCDAVGAVAGEYSVSGDAYLSLSYDYSNGHKWRNVGILIAFL
VVLLAVMLFAEFNESAKQKGEVLLFQWSTLRKIKKDKASNDLEAGKERDVTEQNDE
GDDVNVEALQAGKDIFHWRDVHYTVKITEEREILAGVDGWVKPGTLTALMGASGAG
KTTLLDVLASRVTMGVVTGNMFVNGHLRDSSFQRSTGYVQQQDLHLDTATVREALRFS
AYLRQPSSVSKKEKDDYVEEVIKILDMQKYADAVVGVAGEGLNVEQRKRLTIGVELAA
KPKLLLFFDEPTSGLDSQTAWSICQLMRKLANHGQAILCTIHQPSAILMQEFDRLLFLAR
GGRTIYFGDLGKNCQTLIDYFESHGSPKCPPEANPAEWMLHVIGAAPGSHANQDYHQV
WLESDERKAVLAELDHMEKELVKLPKDESIGNDEFAAPFYKQFLLVTERVFQQTFRTPS
YIWSKLCLSIIPSIYIGFVFFNANATMQGLQNQMFSVLMFITIFNPLLQQMLPTYVAARDL
YEMRERPSKTFSWKAFMLSEIVSEIPWNALIGTIAFFCWYYPAGFYHNSHSTAEVNQRG
AYAWFFCVMFFVYIGTMAHMCIAPIRLEDMAGTIAYLFFTLCITFCGVMVSPDILPGFWI
FMYRVSPMTYFVSGYLANAVAHADVICAENEYRVVTPPPGVSSCGEYFESYIEAAGTGY
LINPNAADQCQFCPLSSTDDWLHSVGISYGEKWRNLGLLWVYMIFNVVAAIFLYWLAR
VPKKSGRVKEQASSKPSTQKEKSS SEQ ID NO: 64 Saccharomyces cerevisiae ABC transporter polypeptide sequence
MAGATSSIIRENDFEDELAERMQSYNRETADKLALTRTESVKPEPEITAPPHSRFSRSFKT
VLIAQCAFTGFFSTIAGAIYYPVLSVIERKFDIDEELVNVTVVVYFVFQGLAPTFMGGFAD
SLGRRPVVLVAIVIYFGACIGLACAQTYAQIIVLRCLQAAGISPVIAINSGIMGDVTTRAE
RGGYVGYVAGFQVLGSAFGALIGAGLSSRWGWRAIFWFLAIGSGICFLASFLILPETKRN
ISGNGSVTPKSYLNRAPILVLPTVRKSLHLDNPDYETLELPTQLNLLAPFKILKAYEICILM
LVAGLQFAMYTTHLTALSTALSKQYHLTVAKVGLCYLPSGICTLCSIVIAGRYLNWNYR
RRLKYYQNWLGKKRSKLLEEHDNDLNLVQRIIENDPKYTFNIFKARLQPAFVTLLLSSSG
FCAYGWCITVKAPLAAVLCMSGFASLFSNCILTFSTTLIVDLFPTKTSTATGCLNLFRCIL
SAVFIAALSKMVEKMKFGGVFTFLGALTSSSSILLFILLRKGKELAFKRKKQELGVNQEI
KLLESKENVPFDRSTTEKEELV SEQ ID NO: 65 Hansenula polymorpha ABC transporter polypeptide sequence
MSDSISVKSGDSQYFGFDSNVETQVRGLARELSHVSAYETEKNDNDARSLIRTLTNYSQ
VPGVNPFVEDGIDSRLNPDSDDFDSKLWIQNMRKLMDSDPEYYKPASLSVAFRNLRASG
VVSSEDYQTTILTAPIKFVMENFNNTFRKHVESRYFDILKPMDGLILPGTFTLVLGRPGA
GCSTFLKTVASQTYGFKVAPESIISYDGFSPKDIESNYRGEVTFSAEKDEHYPQLTVRQTL
GFAAKLKAPRNRPQGVSAQAYADHMTKVYMAMYGLSHTADTKVGNDFVKGVSGGER
KRVSTAELSLCGSKIQCWDNSTRGLDSATALEFLRALKTSATVLRTTPITSVYQCSEDSY
NLFDNVLLLYEGYQIYYGPASHAKQFFQKMGYVCPPRQTTADFLTSLTSPKERIPREGM
ENRVPRTPKEFNDYWRQSPEYADMVAQTDAYIKKSAADDLREQFHQSHVARQEKGSR
SRSPYTSTYWTQVRENMRRYWWKIKGDPSLLYFHIFFRVAISLVISSLYYNLKNTTSDLY
YRGACMFFATMFNAMSVMMEVITCFEARQIAEKHKKYALYHPSTDALASVITEIPNKVI
INTGFNLVFYFMVNFRRTPGHFFFYLLTNLTSTFTMSHMMRSLASLFRTLSEAMTPSMFL
VSLLVLYTGFAVPVKDMHGWSRWINYLDPIAYAFEALIANEFHGRQFECNDPIPGYPGV
PQENTICNTLGAEAGETTISGTKYIALAYKYYAKHKWRNWGINLSFAIFFLGVYLLLVEN
```

-continued

Illustrative Sequences

SKSAMQKGDVLLFLSSWFKTPTHARAKSDIETANNIESVNYAKDEAGSSSDSGRLATGN
GIFHWRDVCFDIKVGKKPKRILDHVDGWVKPGTLTALMGASGAGKTTLLDVLANRVTI
GVVTGSIFVNGQERNQSFQRFTGYAQQQDLHIQTATVRESLRFSAYLRQDASVSKQEKD
DYVEEIIRVLEMESYADAVVGEAGQGLNIEQRKRLTIGVELVAKPQLLLFLDEPTSGLDS
QTAWSICQLMRKLSNSGQAILCTIHQPSARLLQEFDRLLFLAAGGKTVYFGELGPNCQTL
IDYFEKNGAKPCPPHANPAEWMLEVIGAAPGSHAKRDYHEVWTHSPERAAVLEELHRL
EETADEKTHQEEAKQRQFATSFATQYHLVTKRMVQQYIRTPSYIYSKLLMAIGVSMFNG
FTFFFHANHTKQGLQDQMLSIYLMCMSGMVYFQQLLPLIEEERNVYEVRERPSKLYSWY
AFVSATFTAELPWSFITGTLSFVTWYLPLGLYRDAEQTNSVSERAGLVWLYLTFFYMYA
TTLGYFCSFGLQVMSNGMNNSFMVFMLSMNFSGVLIYPTGFWTWLYHVSPLTWWIGGI
VPAGIRDTRIRCASDEYVKFPPLSGQTCGQYMQEFITKNGGGYVVNPDATDMCEFCSMS
NSNQFLLGRHMNPDHMWRNFGLIIAYTAFNIICTYAFYYIFRVPKKGSRVEKETFFIEEED
EEDEKAAPKKWWQKLGKKN

SEQ ID NO: 66 Saccharomyces cerevisiae ABC transporter polypeptide sequence
MGSCCSCLKDSSDEASVSPIADNEREAVTLLLGYLEDKDQLDFYSGGPLKALTTLVYSD
NLNLQRSAALAFAEITEKYVRQVSREVLEPILILLQSQDPQIQVAACAALGNLAVNNENK
LLIVEMGGLEPLINQMMGDNVEVQCNAVGCITNLATRDDNKHKIATSGALIPLTKLAKS
KHIRVQRNATGALLNMTHSEENRKELVNAGAVPVLVSLLSSTDPDVQYYCTTALSNIAV
DEANRKKLAQTEPRLVSKLVSLMDSPSSRVKCQATLALRNLASDTSYQLEIVRAGGLPH
LVKLIQSDSIPLVLASVACIRNISIHPLNEGLIVDAGFLKPLVRLLDYKDSEEIQCHAVSTL
RNLAASSEKNRKEFFESGAVEKCKELALDSPVSVQSEISACFAILALADVSKLDLLEANIL
DALIPMTFSQNQEVSGNAAAALANLCSRVNNYTKIIEAWDRPNEGIRGFLIRFLKSDYAT
FEHIALWTILQLLESHNDKVEDLVKNDDDIINGVRKMADVTFERLQRSGIDVKNPGSNN
NPSSNDNNSNNNDTGSEHQPVEDASLELYNITQQILQFLH SEQ ID NO: 67 Kluyveromyces marxianus ABC transporter polypeptide sequence
MGQSERAALIAFASRNTTECWLCRDKEGFGPISYYGDFTVCFIDGVLLNFAALFMLIFGT
YQVVKLSKKEHPGIKYRRDWLLFSRITLVGCFLLFTSMAAYYSSEKHESIALTSQYTLTL
MSIFVALMLHWVEYHRSRISNGIVLFYWLFETLFQGSKWVNFSIRHAYNLNHEWPVSYS
VYILTIFQTISAFMILILEAGFEKPLPSYQRVIESYSKQKRNPVDNSHIFQRLSFSWMTELM
KTGYKKYLTEQDLYKLPKSFGAKEISHKFSERWQYQLKHKANPSLAWALLSTFGGKILL
GGIFKVAYDILQFTQPQLLRILIKFVSDYTSTPEPQLPLVRGVMLSIAMFVVSVVQTSILH
QYFLNAFDTGMHIKSGMTSVIYQKALVLSSEASASSSTGDIVNLMSVDVQRLQDLTQW
GQIIWSGPFQIILCLVSLYKLLGPCMWVGVIIMIIMIPINSVIVRIQKKLQKIQMKNKDERT
RVTSEILNNIKSLKVYGWEIPYKAKLDHVRNDKELKNLKKMGCTLALASFQFNIVPPLV
SCSTFAVFVFTEDRPLSTDLVFPALTLFNLLSFPLAVVPNAISSFIEASVSVNRLYAFLTNE
ELQTDAVHREPKVNNIGDEGVKVSDATFLWQRKPEYKVALKNINFSAKKGELTCIVGK
VGSGKSALIQSLLGDLIRVKGYAAVHGSVAYVSQVAWIMNGTVKDNIIFGHKYDPEFYE
LTIKACALAIDLSMLPDGDQTLVGEKGISLSGGQKARLSLARAVYARADTYLLDDPLAA
VDEHVAKHLIEHVLGPHGLLHSKTKVLATNKISVLSIADSITLMENGEIIQQGTYEETNNT
TDSPLSKLISEFGKKGKATPSQSTTSLTKLATSDLGSSSDSKVSDVSIDVSQLDTENLTEA
EELKSLRRASMATLGSIGFDDDENIARREHREQGKVKWDIYMEYARACNPRSVCVFLFF
IVLSMLLSVLGNFWLKHWSEVNTGEGYNPHAARYLLIYFALGVGSALATLIQTIVLWVF
CTIHGSRYLHDAMATSVLKAPMSFFETTPIGRILNRFSNDIYKVDEVLGRTFSQFFANVV
KVSFTIIVICMATWQFIFIILPLSVLYIYYQQYYLRTSRELRRLDSVTRSPIYAHFQETLGGL
TTIRGYSQQTRFVHINQTRVDNNMSAFYPSVNANRWLAFRLEFIGSIIILGSSMLAVIRLG
NGTLTAGMIGLSLSFALQITQSLNWIVRMTVEVETNIVSVERIKEYAELKSEAPYIIEDHR
PPASWPEKGDVKFVNYSTRYRPELELILKDINLHILPKEKIGIVGRTGAGKSSLTLALFRII
EAASGHIIIDGIPIDSIGLADLRHRLSIIPQDSQIFEGTIRENIDPSKQYTDEQIWDALELSHL
KNHVKNMGPDGLETMLSEGGGNLSVGQRQLMCLARALLISSKILVLDEATAAVDVETD
QLIQKTIREAFKERTILTIAHRINTIMDSDRIIVLDKGRVTEFDTPANLLNKKDSIFYSLCVE
AGLAE SEQ ID NO: 68 ABC transporter polypeptide sequence
MAAFSSLVASQDVLYRLLADLARKDTKSFRRTLAQLDRRTRLIIALVSALSSASVVALV
RHNAKSAKQEATRARELHRQNSAVKLNDGSQEIFVPSGGSKGGQSRVVIRPTRRVTFEA
HRRLFLKSPEKTTMGGEHKTGINRTFMREFGAIWSIIVPHLKSKTSGLLFIHALFLAARTY
LSLLVAKLDGRIVRDLIAGHGRQFARGIVLWLLLAIPASYTNAMIKFMQAKISIAFRTRL
VRYIHDIYLDAKLGYYKVSNIDGGIEGADQYITADVTRFCDAAAALYSNLGKPSVDFAIF
SYQLYQNLGPLALIGIFGNYMATAWVLKRLAPPFGWLTAVEARLEGEYRSGHTKLITNA
EEIAFYDGTGLERSILRDTYRRLTRHVANILRIKVSYNMFEDFMLKYSWSAMGYIFASLP
VFLPTWAGANSHALVEAKDHEEKPHSASIATARRDFQERSRMREFITNKRLMLSLADAG
GRMMYSIKDLAELAGYTSRVYQLLSTLHRVHASAYDRAPGSGPIEPYSLADVRGTVQQ
GFKGVRFEHTPVVVPGLGKDNSPGELLIKDLDIRINPGDHILISGANGVGKSAIARVIGGL
WPVYRGLVSKPMPSDISFVPQRPYLSNGTLRDQIIYPASHADMLDAKRSDDELMEILKK
VKLEYLPSREGGWETKKQWKDVFSGGEKQRVMFARILYKKPMFAVIDEGTSAVSADV
EGLLYETCKKQGITLITISHRPSLLQYHNAQLKIGLGDHRDEWVLEKTDTEEGRLSVEHE
IEELEKQLSQVDAWKARRHEIDALLSGKSQ SEQ ID NO: 69 Saccharomyces cerevisiae ABC transporter polypeptide sequence
MRGLTPKNGVHIETGPDTESSADSSNFSTGFSGKIRKPRSKVSKACDNCRKRKIKCNGKF
PCASCEIYSCECTFSTRQGGARIKNLHKTSLEGTTVQVKEETDSSSTSFSNPQRCTDGPCA
VEQPTKFFENFKLGGRSSGDNSGSDGKNDDDVNRNGFYEDDSESQATLTSLQTTLKNLK
EMAHLGTHVTSAIESIELQISDLLKRWEPKVRTKELATTKFYPNKSIETQLMKNKYCDV
VHLTRYAAWSNNKKDQDTSSQPLIDEIFGLYSPFQFSLQGIGKCFQNYRSKSKCEIFPRT
AKETIYIMLRFFDVCFHHINQGCVSIANPLENYLQKMNLLPSTPSSISSAGSPNTAHTKSH -continued Illustrative Sequences VALVINHLPQPFVRNITGISNSELLSEMNNDISMFGILLKMLDMHKNSYKNFLMEITSNPS
VAKNTQSIDVLQEFIHYCQAGEALIALCYSYYNSTLYNYVDFTCDITHLEQLLYFLDLLF
WLSEIYGFEKVLNVAVHFVSRVGLSRWEFYVGLDENFAERRRNLWWKAFYFEKTLAS
KLGYPSNIDDSKINCLLPKNFRDVGFLDNRDFIENVHLVRRSEAFDNMCISDLKYYGELA
VLQIVSHFSSSVLFNEKFTSIRNTSKPSVVREKLLFEVLEIFNETEMKYDAIKEQTGKLFDI
AFSKDSTELKVSREDKIMASKFVLFYEHHFCRMVNESDNIVARLCVHRRPSILIENLKIYL
HKIYKSWTDMNKILLDPDNDYSVYRSFAHYSISCIILVSQAFSVAEFIKVNDVVNMIRVF
KRFLDIKIFSENETNEHVFNSQSFKDYTRAFSFLTIVARIMLLAYGESSSTNLDVISKYIDE
NAPDLKGIIELVLDTNSCAYRFLLEPVQKSGFHLTVSQMLKNRKFQEPLMSNEDNKQMK
HNSGKNLNPDLPSLKTGISCLLNGIESPQLPFNGRSAPSPVRNNSLPEFAQLPSFRSLSVSD
MINPDYAQPTNGQNNTQVQSNKPINAQQQIPTSVQVPFMNTNEINNNNNNNNNKNNI
NNINNNSNNFSATSFNLGTLDEFVNNGDLEDLYSILWSDVYPDS SEQ ID NO: 70 Saccharomyces cerevisiae ABC transporter polypeptide sequence
MRWDVIILYAISRPYATRRTGSHTHPRDSRYIAANQRRPPSACRVGPSPAKQRKDIPIFEL
LDTTLIKNALFALTSFLYYRTNILTCPFLNFLYLSRTGQLDKFCKDQTVTQILAT SEQ ID NO: 71 Pinchia pastoris ABC transporter polypeptide sequence
MKENDTPRVGISVRDLAVVTKKSRRAFFSSSSKRNDVPTSKVLLEATSFDIEPGTITAIMG
GSGSGKTTMLNCLANGNENSGNINIQGTIAYNGKTNINTISHAYVIQQDILLPNLTCYETL
MYSAELRLKEPKEKLVEIVDQVILELGLKDCRNTLVGNDTHKGLSGGEKRRLSIGIQML
CNPSVLFLDEPTTGLDAYSALLLIQTLKNLANQGKTFVLSIHQPRSDIFFLFDNLILLSRGK
TCYSGPLDKVIPYFEQIGYHVPKQVNPADYFIEIVSINMKDQETENKCWESLSKISDHWK
DSHDFEPISVDPTFVSKVKSPVSFSKKIKILTRRDMLLSFRSPLILLSLLIETIAVSLICGWVF
FIPGSSLRGIRTMTGALYTTNGLQPYLFLLFEVYRLSSVDIKIYDRERSEGVVSAPSFLISR
RISKFFTEDVWIPILESIIGYFMFGLRTDSPRHFFIYFAAVYIAHLVSMCFAMACVSISREY
ALASLMANLNFTLQSMACGYLANSRVIPYVVRWTKYIAYLWYGYGAVISNQFTGFRGE
CFQDTSQPNIDEVCAAYYGNNIIRNLGFWPNFIALPLCVEVAMAFGFYLFAGLMLTYKT
KSRSALSQEVSSSSKRKSLKSSTQDATKEAEVLVRDGLTITLKDASLKVRVRKVLERTST
EKEILHGVNAEFKPGQLNTIMGPSGSGKSSLLNLISGRLHSNVTTSYTSIGDIFLDSQLASF
QDMDEICSYVSQDGDHLIPSLVRETLLFAARLRLNLERHQVEKRVDEIILKMGLRDVAT
VLVGSEFVKGISGGERKRLSIAIQLINDPPILLLDEPTSGLDAFTAGSILKVLQTLCDENKT
VVLTIHQPRLDLFHSLGSILLLAKGGHVAFKGTPNEMLEHFESMGYPCPAFVNAADHVL
DVISVNVQNEINETISRKRVNLFLDEWKSRDNQETKLLAVNTFSMEDVAIKKRSSFMKG
YTILLQRQALCIRRDTNILFGRIAQIAGLGIILALFYSPLKHDYTSIQQRLGALQQMTALYF
IGMLNNIMIFPLERTSFYTEYKDKVVSAESFFMAYLTLELPFELVSGAFFSVFMVMVIGFP
RTPGLFFAMYYASICIVNCGESLGVIFNVIFDEVGFAVNIISIFLSIATFMTGVMSLNMGAF
LRGINWLSPLYYAVMGVLNLAFPPSLRLTCEDDFRNPDGSCIFSNGTDVLEIYQLKKNW
QLLLGLLIVVVFVYRGIGYVMLKLKVRGF SEQ ID NO: 72 Saccharomyces cerevisiae ABC transporter polypeptide sequence
MSTNKFVVRITNALFKSSLASNSPPVYPKRIRHFEILPNEKWVIWGPGKGKFLDVLNNKY
ICEPPLSLRFGFLKESSNILPRIEQVAFKGVMPTAHLSARYEYFKDDYDQTCKQFIFDKAS
GSNAVSYKVETNNRQINMELYNALVENLNLSSLQDRWVMGLSNGQMRRARLARSILK
EPDLLLIDDPFLGLDPAATATISQFLAKYDSIEVSGGCPIVIGLRYQDTIPAWCTHICCVDE
KNGILFEGPIEKLQSKMDETRSRALKELEQLKKASNSKEDISINDLICIHPMYGKKEHEIIK
MPHLIELDGLSVSYKGEAVLENLHWKVQPGSKWHIRGDNGSGKSTLLSLLTAEHPQSW
NSRVIDNGVPRRTGKTNYFDLNSKIGMSSPELHAIFLKNAGGRLNIRESVATGYHEASSN
NYLPIWKRLDKNSQDIVNMYLKYFGLDKDADSVLFEQLSVSDQKLVLFVRSLIKMPQILI
LDEAFSGMEVEPMMRCHEFLEEWPGTVLVVAHVAEETPKCAHYLRLISPGEYEIGDME
N SEQ ID NO: 73 Saccharomyces cerevisiae ABC transporter polypeptide sequence
MTELCPVYAPFFGAIGCASAIIFTSLGAAYGTAKSGVGICATCVLRPDLLFKNIVPVIMAG
IIAIYGLVVSVLVCYSLGQKQALYTGFIQLGAGLSVGLSGLAAGFAIGIVGDAGVRGSSQ
QPRLFVGMILILIFAEVLGLYGLIVALLLNSRATQDVVC SEQ ID NO: 74 ABC transporter polypeptide sequence
MANVSTLRPLLIEALQDPVKLRAFISTYLASLRQMSPRRLRVIAVVAFLLVGSCTGIAGQ
ALLDNLNTKKSKKKVPLHRMDSAVKLSDGSKQIVVPYKEGQTTVTIKPTKQVTFEAHR
RLFLRPDDSEGGEAKSGINGRFLRQFSALWVIMVPRLQSRESLILLVHALFLFLRTWISLL
VAKLDGQIVRDMIAGDGRKFLRGLGYWFAIAVPASYTNAVIKYLQAKLSLAFRTRLTR
YVHDLYLDADLAYYKIADIDGGNVGTSADQFITTDLARFCDKAAALYSNLGKPFVDPLI
FTFQLSKNLGPMALIGIFANYGLTAYLLRRLAPSFGKLAAIQAKLEGEYRAAHSKLITNA
EEIAFYDGTSLERTILEKAYIRLARHIRGIYRIKIFYNMFEDIILKYTWSAIGYMFASLPVFL
PAWTSIKEKTKETTASAVTASMDFSEQDHMRDFITNKRLMLSLADAGGRMMYSIKDLA
ELSGYTSRVYMLLSVLHRVHARAYTSRILKTPIKEAASKEAKEEGIVIGEKPDPDSSSELS
EEEQFTLNSISGTIQPRYPGVRFEGVPIVAPSAVGSGELLVRDLNVLIKPGEHILISGPNGC
GKSAVARVIGGLWPVYRGLLSRPDISEIGFLPQRAYLSIGSLRDQIIYPDSHADMISKNVT
DADLQTILDRVHLGYLPSREGGWNTRKEWKDVFSGGEKQRVMFARILYHRPKFAVIDE
GTAAVSSDVEGSLYENCKKDGITLITISHRPSLMKYHKAQLKLGLGNDGKDWDLEIVGS
KEARLSVEKEIQSLEEKLSKVDEWKKRKTEVEAILRGEVKHEQKPGFQEIVTENVQNTG
DDTGVLLKTDTIVGVGKESEEEDVKEMKQQLGSVVKAEGDAAVKEQAAKELNEATEK
LEAAKEKTDKGDVKVEGGADKPAAAKTSNPKKSEKK -continued

| Illustrative Sequences |
|---|

SEQ ID NO: 75 *Saccharomyces cerevisiae* ABC transporter polypeptide sequence
MSSIHEVVALIEELYSPHPKHDVNQIQQSLQSIQKSEQGFHLANELLSDDKYSANVKYFG
ALTLTVQLNTRGENDYETLWNVFRSNLLYLTKFSTLYVSNPNMYGQSLIIIKKLMSNLSL
IFTKINDPQLNNAGNENMIKQWNNPINTFIQLMSVQNQNINADQLLLDSINCSLTYEQLS
QFVSLSQKHNELALTFTEVIVEDLTKFQTKRHSMSQIHEVVHEHLYISTMALINLNLTAQ
AVFNPTVFDCITAWINYISLTRSVSSSGRMDLSEIFQNLIDLMYQSTEGSDGYENAEKILTI
FGNVFANDPLLMSYDLRQQIECIFLGVVRPDSGITDISNKNSWMLQYMNYLVTNDFFSE
LKELAICIVDFLQINTLSVCNKLFTNIQAADNGQVQDEYIQEYIKVLLQMTNFPLTPVLQE
FFSVRMVDFWLDLSDAYTNLASETLRPNSIELSTQIFQQLINIYLPKISLSVKQRIIEEEGES
TSVNEFEDFRNAVSDLAQSLWSILGNDNLTNVLIDGMGQMPAASDETLIIKDTDVLFRIE
TMCFVLNTILVDMTLSESPWIKNIVDANKFFNQNVISVFQTGFQTSASTKVSQILKLDFV
RTSTTLIGTLAGYFKQEPFQLNPYVEALFQGLHTCTNFTSKNEQEKISNDKLEVMVIKTV
STLCETCREELTPYLMHFISFLNTVIMPDSNVSHFTRTKLVRSIGYVVQCQVSNGPEEQA
KYILQLTNLLSGSIEHCLASSVQLQEQQDYINCLLYCISELATSLIQPTEIIENDALLQRLSE
FQSFWSSDPLQIRSKIMCTIDKVLDNSIYCKNSAFVEIGCLIVGKGLNLPDGEPYFLKYNM
SEVMNFVLRHVPNCELATCLPYFVYLLEKLISEFRKELTPQEFDFMFEKILLVYYDAYIIN
DPDLLQMTIGFVNNVLDVKPGLAIGSKHWTSFILPQFLKLIPSREKFTIVAVAKFWTKLIN
NKKYNQEELTTVRQQVSSIGGDLVYQIMYGLFHTQRSDLNSYTDLLRALVAKFPIEARE
WLVAVLPQICNNPAGHEKFINKLLITRGSRAAGNVILQWWLDCTTLPNYQG SEQ ID NO: 76 *Saccharomyces cerevisiae* ABC transporter polypeptide sequence
MSTDESEDVYSDLYSIISQVTSNTANDIEQLPYALTFKTSLIFVGATIGGLLFGYDTGVISG
VLLSLKPEDLSLVVLTDVQKELITSSTSVGSFFGSILAFPLADRYGRRITLAICCSIFILAAI
GMAIARTLTFLICGRLLVGIAVGVSAQCVPLFLSEISPSRIRGFMLTLNIIAITGGQLVSYVI
ASLMKEIDNSWRYLFALSAIPAILFLSILDFIPESPRWSISKGDILYTRDSLRMLYPTASTY
HVNSKIKQLIIELDKLRLYEDASEPLLVQSQSVIRYMDSSTSGTLSPPNIKRLSSNTERTSN
TMSSSSAYLSALRGPAPNGALASNKKKRHRMEPRTIRALIVGCNCLMFFQQITGFNAPMY
YAAIIFSKFNIKNPLLPPILIASTNFIFTFFAMYTMDSLGRRAILLRTILIMTVGLLLCSVGF
GHDQVNLLLISVVIYVAAYASAMGSVPWTCVEFLPLNRRSFGASCIACTNWLTNAFVS
MTYLSTINTIGDENTMLIFAFFTVCAWFFVYFWYPEVKGLSLEEVGRVFDNGIDVHYVF
RTYH SEQ ID NO: 77 *Saccharomyces cerevisiae* ABC transporter polypeptide sequence
MAETERLMPNGGSRETKPLITGHLILGTIVACLGSIQYGYHIAELNAPQEFLSCSRFEAPD
ENISYDDTWVGQHGLKQCIALTDSQYGAITSIFSIGGLFGSYYAGNWANRYGRKYVSM
GASAMCMVSSLLLFFSNSYLQLLFGRFLVGMSCGTAIVITPLFINEIAPVEWRWAMGSM
NQVSINLGILLTQTLALKYADSYNWRWLLFSGSVIAVANILAWLKVDESPRWLVSHGFV
SEAETALFKLRPGTYQQAKQEIQDWQRSHGHNRDPESSEETHSGPTLWQYVTDPSYKKP
RTVILAILSCQQFCGINSIIFYGVKVIGKILPDYSIQVNFAISILNVVVTLAASAIIDHVGRRP
LLLASTTVMTAMSLLISVGLTLSVSFLLVTATFVYIAAFAIGLGPIPFLIIGELSYPQDAAT
AQSFGTVCNWLATFIVGYLFPIGHGLMGGYVFAIFAAIAAMFATYVYKRVPETKGKTTY
SEVWAGY SEQ ID NO: 78 *Kluyveromyces lactis* ABC transporter polypeptide sequence
MIMLQVPNATCEFGLRPYISPEVNALNPCFISWVCVIFVAHFIAIGGFQYVSLRNKETGPA
TFETKRFWTFRNMSIFHVIHMINVLFQCVLLLIQLSWVKDEPTWTKWSISLNLFYVAIVY
LNSTWLAYYKSSCAQGHGLFYFIIYSFVVAFEIGQRYFHAGTERYNVIKNGASAMIVDIL
LWFNSMSIFCYDTFLFKCSPQLTNYFAVNNIYPPVNVLAGISFTWMNKLIMDTYHANKIE
DPSNMPLPPFDLDIAEATTAVEANWEYELWTDRKSLLLALLKTFGPTIAIAMSYEVSRSL
LSVIQPQLFRKFIEVFNPDSRDLPILNGFFVAIGLFLLSILSTIISNQFFINIFEAGLKIRGSLM
SLVYQKSLRLSAEAREDKANGDVLNLMSVDVIRIQRFFENAQILVGSPIQLIGVLISLYVL
LGNATIGGLVSIVIMVPINSYMTRLYKKLFKTQMQYKDKRIKTVTEILNSMKSIKLYAWE
KPMLDRLNHVRNDLELHNMKKIAIVSNFMFFCWNIVPLLVTCSTFVLFSYLTDQVLSPQI
IFPPSLTLFSMLNDALFTVPTMISNIIEIGVSLKRLKGYLLAEELDTSFIEHARATASDPTVEI
SNAVFLWKSPKSAASSEDTDEEAEISSPGVALKSIENFSAKKAQLTCIVGRVGSGKSTFL
QAILGQLPCVSSDSASGVKPKVVIRADNLAYCPQQPWIMNASLKDNILFGYKYDEAMY
KKTIKACQLLPDLEILPDGDQTLVGEKGISLSGGQKARLSLARAVYSRADLYLLDDVLS
AVDSHVCKSIIDDVLDRQKGLLKNKTVILTTNAVNVLVHSDMIYLLKNGKIVESNSYEE
VMSKDRNNGEKSSLREIIEEFASNESEETAEKKSESSTIDDKNVGSSSEDDGDLEGAPQPP
EHLLNYEAAKNPDNNTITAYEEDQENADLARVASRRASIATLKPRPLIDMNKDERKTAQ
KAETKEEGRVKSSVYLSYIKACGILGVALFFVLMISMKLLDLAKNFWLKHWSEDNLTH
GANKDIWKYVAVYALIGVTSSAFELARTIIMMLFCSIRASKLFHNQMAHSVVMAPMSFF
ETTPVGRIVNRFSSDVNSIDEDFQHIISFFFRSMLDYLITIVIITVSMPWFLLFNTILLGIYYY
YQTLYVVLSRELKRLTSISYSPVMSLLSETLGGHVVINAYKHANIFNYYNFENIQTNINFI
FNFRSTNRWLSMRLQTIGAVIVLITSLMALASLGTSNPISAGLIGLLMSYALQVSSSLMWI
IRMAVNIETTIVSVERIIEYRDLKPEGIRVIEDSRPPKNWPKRGEITFEHYTTKYRENLDPV
LKDIDLRIKHQEKIGVVGRTGAGKSTLTLALFRILEPFEGKITIDGIDISTLGLYDLRRSLSII
PQDAQAFEGTVRSNLDPFNRHTDAEIWKALELSHLKPHIERIVSELPDDENKPTDLLDTQ
ISDNGNNLSMGQRQLLCLSRALLNPSKILILDEATAAVDRETDKIIQETIRTAFKDRTILTI
AHRIDTVLDSDKIMVLDKGEVKEFDTPDNLLKNKESLFYGLCEKGGYLKEE SEQ ID NO: 79 *Pichia pastoris* ABC transporter polypeptide sequence
MSSLNSSSKEDDSASLEKQILPEMARQKRLFSFLLPSTIPPLPTDQERKPYPAGVQFSDIPY
HQWVPAFISRIFFWWVVPLLKTGYVRTIFPNDLYYLERSLKVEALADKFKKVYQKEVD
KRASPNEPMKLTTFMKPLFKTIGVYYFYAIGFKIIFDCGTTLAPLLTKELIKYVSLKSVGV
EPGIGKGVGYALGASFLIIVPGICNHSLYYSTLCGQVLYSVLNKMVLEKSFRLDGVAEH

| Illustrative Sequences |
| --- |
| NYPIAKINSMLGTDLSRLELAFTFSPFMMTIPVTMAIAITLLIINIGVSALAGLGMFFLCLVI
VFSAIPLIIKIRIKIMGSTDKRVSHIKELANYLKFVKFYSWENSYFSSLTNARTTEMKYTFR
MHAIRNSLTALAVSTPALSSMLAFVVAHAVSRDRTPAEIFSSLSLFNVLSMIVFLLPMCLF
LSADALLGLKRVCNFLQAPEAHLYDEQETLKTDVALQAKNGTFYWETFENEDDTVAID
HKTTENNKAFSRLKNINLEVKKGEFLVITGLIGTGKSSLLAALSGQMKRESGSVSHQGSL
LLCGEPWIQNTTIRENIVFGQPFDETKYWEVIKCCALTQDLDMLDHGDITEVGERGITLS
GGQKARINLARAVYNDRDILLMDDVLSAVDARVGKHIMDNCIMGLLHDKTRILATHQL
SLISTADRICFLNGDGTIDVGTFEELSARNQNFTNLMVFNSESSESKDEEKELKLIKSTTLT
IEEKLPRFHDINDGKLMKKEQRAINGIPIDVYKTYISMGSGVFGKLFSPMFILVVAVTTFC
QLFTNVWLSFWTSNRFSHLSEGIYIGIYIMFTFLSMITVTTEYTLIAYLTNKASTKLNIAA
MKRFLHVPMSYLDTTPIGQIINRFTKDTDTLDNEIGEQFRMVVYPSANVIGVLIMCIAYLP
WFAIALPFLFLLFLLICSFYQATAREVKRIESIQRSFVFSHVNEVLNGMHTIKSYQREDSFI
SKNDLLLNNMNEASFITNVAQRWLAVILDTIGAGFAFLITMLCVTRQFDIGPSSVGLLVT
YLFQIVGQMSLLIRSITQLENNMNSVERLYEYSYNLPQEASYDSPSRPSPPSTWPENGVID
FKDVSLRYRPGLPLVLKNINIHIPSRFRVGICGRTGAGKSSIMTALYRINELAGGQIVIDDV
DISTLNLYDLRSNLSIIPQDPVLFKGTIRKNLDPFGEKEDDVLWAALLKSGIVESSSELEQ
VKLQKKKGQEELHKFHLDQVVEDEGSNFSLGERQLIALARAIVRDSKILILDEATSSVDY
KTDAKIQSAIVREFNKCSILCIAHRLKTIVNYDRILVLEAGQVAEFDTPWRLYHKSSGIFR
AMCEKANIMEHDFDNRS SEQ ID NO: 80 ABC transporter polypeptide sequence
MSSKADEDNIEAYNADSEGTDSMNEVHELARQITNQSIRSGTGSLHNPFVDSKDPALDP
NSDDFDSRKWLRQVMNIKLRDPDNYPPGIAGVAFKNLGAFGYGTSADYQKTFLNATLE
VVSLAKRIVGLEKKTKITILREFNGLVRPGEICIVLGRPGSGCTTLLKTLSQNTHGFHLTD
ETVLNYQGIPPEAIHKHFRGEFIYNAETDTHFPHLTVGQTLKFAALARTPKNRIEGVTRD
QYATHLRDVTMATFGLSHTLNTKVGDDFIRGVSGGERKRVSLAEAFVNGSALQCWDNS
TRGLDSATALEFIKTLKNHADYADVCCFVSLYQASQDAYDLFHKVTVLYEGRQIYFGPT
DRAKKFFTDMGFVCPDRQTTGDFLTSLTNPDERIVAPGFEEKVPRTADDFEAVWRNSED
YRQLIAEIDEYNAAYPVGGEAFQQFQHSMVTKKANRARHGSPYTLNFGMQVQLCITRG
FQRLFGDLSMAATTVFGNNAMALIVASIFYNMSQDTNSFFSRSALLFFSILMNAFSSALEI
LVLYAQRPIVEKHTRYAFYHPSAEAFASMLVDMPTKIITTLFFNIIIYFMTNLRREPGPFFI
FYLFSFVCMLVMSMVFRTIAACSRTISEAMTPASIFILALVMYTGFAIPTRYMVVFRWI
NYINPIGYAFETLMINEFNGRQFKCSGMMPTFENATGTERTCYVQGYNAPKGAEYIDGG
EYIASAFGYYHAHKWRNFGILIGFMFFFLGTYLVATELIQAAKSKGEVLVFKKGHVPYG
KGNDPEAGDVPAGAIRDPADSSGMISEKSSGQINLQKQTGIFQWMDVCYDIKVKGPEKT
RRILTHVDGWVKPGTLTALMGASGAGKTTLLDVLASRVTMGVVTGDMLVNGKLRDES
FQRKTGYVQQQDLHLETSTVREALTFSAVLRQPKSVPKEEKIAYVDEVIRILEMESYAEA
VVGVPGEGLNVEQRKRLTIGVELAAKPELLLFLDEPTSGLDSQTAWSICSLMRKLANNG
QAILCTIHQPSAMLFQQFDRLLFLAKGGRTVYFGDIGENSRTMIDYFERNGADPCPPDAN
PAEWMLTVIGAAPGSHANKDYHEVWVNSPERVTLRKELEEMAENLRNTPDDNNDNEL
HRSFASSLSTQLVEVTKRVWQQYWRTPSYIWAKIVLTTISPAFIGFSFWQAKNDMQGLQ
NQMFAFFMLITIFGNLIQQIMPHFVTQRALYEARERPSKTYSWPAFIISNVVVELPWQTL
VSVLSFVVVYYPVGFYRNASWTDSVHERGALFFMLIWVYYLFVSTFAHMVIAGIETAD
TGGNIGNLLFTLTLLMCGVLATPSALPGFWIFMYRVSPFTYLIAGFMGSGIGNAPMKCSS
RDYVHFDAPAGMTCQEYVGDFAASSGGYLLDGNATSCEYCPMSNTNQYLGALEMQPN
DGWRNFGILFAYVAFNIFGALFFYWLLRVPKKRKIAKTKKE SEQ ID NO: 81 Kluyveromyces marxianus ABC transporter polypeptide sequence
MMLRISMSALLVYMWLTLAANAKLMNNEGVFDQVSVPPRNRRPPSDDQCPPCFNCML
PIFECKQFSECNSFNGRCECIDGFGGDDCSVPLCGALSSGNSKRPLRSNETNTCECESGW
GGINCNICEEDYVCDAFMPSGLKGTCNKNGMIAKSLHQGCDVTNPKILEILKGSKPQVT
FACNKTSELCNFQFWIDQVESFYCGLDTCSFEYDLQQNTTHYKCDNVKCKCVPGQMLC
GKKGSIDISDFLTETIKGPGDFSCDLESKKCQFSEPSMNDLILTVFGDPYITLKCESGECLH
YSEIPGYKTPDKSKLSTGSILVLVLSSAGVLVAISISVYFISKSPIFANSPIMLPDDSSDDDF
DLYKTNSTATLTFENITYKVFPTKNTSTTIILNEVTGSVKPGEMLAIMGGSGAGKTTLLDI
LAKKNKTGKVTGSIKVNGTEIDKEEYSKIIGFVDQDDYLLPTLTVYETVLNSALLRLPRQ
LSFKAKQKRVYDVLEQLRIYDIKDRVIGSEYERGISGGEKRRVSIACELVTSPQVLFLDEP
TSGLDANNANNVIECLVRLANHYNKTLVVSIHQPRSSIFQLFDKLVLLSDGEMVYSGEA
YKVSEFLKNEGYVCPQDYNIADYLIDVTFEPSKFITKATIDDVNATIPSTEAQNPIHRVEH
ARRSLTGTATQTEWEHLAIHRDEFRGLLAQSENEEQTIGEVNSQLLHSLFKDGQYFQKL
KFEINELSSSGTEEELRIPHAYKAATFMQQVSILSSRTFKNVYRNPKLLLGNYMLTIFLGF
FLGTLYYDVDNDISGFQNRLGLFFFILTYFGFLTFTGLSSFALERLIFIKERSNHYYSPLAY
YMAKVISDILPLRVVPPILLGLIIYPLVGLNMANNGFGRFTLILVLFNLAVSLEILTVGIIPFE
DLNNSIIVSVLIILASLLFSGLFINTKDIENYFFKYLKNLSVFYYAYESLIINEVKSLMLREK
KYGLNIEIPGATILSTFGFIVQNFVFDIEILVLFNVFLVLGYLALQLIVVEQK SEQ ID NO: 82 ABC transporter polypeptide sequence
MVSIRLVGLAVLSVTGVLATTSPLESDRPDECPPCFNCMLPAFSCKQFATCNEFNGRCEC
PDGFGGDDCSEPVCGGLSDGRNRPIRQGDECQCKEGWGGINCNMCEENDACDAFMPG
GEAGTCYKGGILVNKNHQMCDVTNRKIVDILKGKKPQVTFSCNRTEAECNFQFWVDQR
ESFFCGLHDCEFETDFLSDKNVTRYSCPKIDCACVPGRMLCGEKGSIDISDFLTETIRGPG
YFECDSKDDNCKFSEPSMNDLIKNVFGDSYITLTCDASECLHYTELPGYHEPVKRVNRA
FVLSTSAIALAILILGGLGVNYLIQVSQEKKVNRIALPSDDDRAKLMMSHKPTSLQFDNV
SYVDNDRQILSNAFGTVESGQVMAILGGSGAGKTTLLDILARKKKKGQAAGDIYVNGK
QYSSKQYKRVIGFVDQEDYLMPTLTVYETIATSALLRLPKTMSDDAKRLRALETMNELG
ILDIKDQIIGDESNRGISGGEKRRVAIACELVTSPSILFLDEPTSGLDAYNAHNVIESLVNL
ARNFDRTVVVTIHQPRSNIFSLFDKVILLAQGKVVYSGAQIRAAEHFSELGYTCPPSYNL |

-continued

Illustrative Sequences

ADYLIDLTMKNSDSSSGESTEGTSSSLLERTQEDDEDLHNPLARAGTDIDVTREWRHYA
SHRDEDRQLLRQRNTGDGSNGARAGGSGSGSRTTGTTAKVEELVEMFNGSTAYAEVK
DDIQRATGNAAAAATSSSDEDDEGQELRGYETVGLVRQFTILSIRTFKNLYRNPMLLLT
HYVIAIILGMFCGVLYFNISNDISGFQNRLGLFFFLLALFGFSTLTTLNLFAQERIVFVRER
ANGYYRPIAYYCAKVLFDIIPLRVFPPIILGMIIYPLAGLSTDNNAFWKFLLILTLFNLTAA
SICLVIGIVIQDSGVANLVGSLVMLFSLLFAGLFLNPDSMPPGTKWFEYASIFHYAYEALA
VNEVRYLTLTERKFGLSIEVPGATILSTFGFDVGALWADVWGLVIFFLVFITWGYVAMH
YMLIERR

SEQ ID NO: 83 Saccharomyces cerevisiae ABC transporter polypeptide sequence
MTKQQTSVMRNASIAKEEHEGSDNNNVDRSSSDAISDNDAERSNSHSEIDNESNFDMVP
YSRFSHKQKMLLVVQCAFTGFFSTVAGSIYYPVLTIIERKFNITEELANVTIVVYFIFQGV
APSIMGGLADTFGRRPIVLWAILAYFCACIGLACAHNYAQILALRCLQAAGISPVIAINSG
IMGDVTTKVERGGYVGLVAGFQVVGTAFGALIGAGLSSRWGWRAIFWFLAIGSGICLVF
STLLMPETKRTLVGNGSVTPRSFLNRSLILHVGSVKKTLHLDDPDPETLEPRTSVDFLAPL
KILHIREIDILLSIAGLQFSTWTTHQTALTIVLSKKYNLSVAKIGLCFLPAGISTLTSIISAGR
YLNWSYRTRKVKYNRWIKEQELQLMEKYKGDKNKVAELIHSNSHYTFNLVEARLHPA
FVTLLLSSIGFTAFGWCISVKTPLAAVLCTSAFASLFSNCILTFSTTLIVDLFPSKASTATGC
LNLFRCLLSAIFIAALTKMVEKMRYGGVFTFLSAITSSSSLLLFYLLKNGKQLSFDRIRAN
DKSAGRSVGKNSEKVST SEQ ID NO: 84 Saccharomyces cerevisiae ABC transporter polypeptide sequence
MTHSLKALFALLFLYTAAVNAGVIGIFNALPPPNTKPINGESPLYQCDILDKQLVEIKEVN
LDPNPPVRGENLTISANGEVFETIEEGAYIDVEVRLGYIRLLSQTFDLCETLEDNDIEGLSC
PIEPGEYNIKKIVEIPGEVPPGKYVVVARAYTEKDDLITCLTGEVIFPPR SEQ ID NO: 85 Saccharomyces cerevisiae ABC transporter polypeptide sequence
MKPPLNMSRSNKPLTQEANSSAHIDRAHQLAQDFNSKQDDTALTSLPHKNPDIFRFENNI
TAHSSRRGSLYRDSDATVVLPLSEHTPRLSMDDPYRQLLQQAEISQLRSKKKRHSSRVL
RTSFISFVVLVSSLSGLDQGLISGNVMTLSFQKYFHYPLTSPLGNIVSIVNLGAFMASLFV
YSGILEPCSRKKMLQISTMIYSLGAIVQVLALNQWCLLLGRFLLGVGMGFAFSMVIIYQF
EFPLPCIRKRTLISIQCVSSVIAYSFGIWINCAFRYLGFAWRYPLSTHVALGIILNLMSFYLI
LESPSWLLKQKNDVEALVLISNVFDDGNFEENQTQLKFRVLKRDILLKSHLQKNSYPYA
YILKDFSSIIKLLIGFQLLTRTNGVDAFLYYSPLILQQMGRGERKSIYLTGLNALIYSIVILA
YVPLVLRKRKEKTNVLLGSIVMCALLFTISFTDWFPKSTTRYISILFAVFLFTHFISWDSIG
WVMTIELLPHLSQAPVILLVSNFYWIFKWFVSLITPILIDRLSWKFYLIPSLSSFISIIFVLKIF
PIETRDERLDSDDDSTGNGSGNHDDVFDDTGSEFSSSPSFSAYQINTLGSSIKQNNQAYSS
IQNEQILPKNGNLSNQTHGSAQNVYFITSDSGPSRTGEFFSFHNRTDPNISDNIAANKPSS
GGGQNSPGDMAVA SEQ ID NO: 86 Calathea utilis ABC transporter polypeptide sequence
MSGERCSRFWDFDDLSPCAREELIGTQWPLVLLCASVATITVKGVYNYVHLGKRVSLR
DDGESEPLLTASQGAPLYTESSAEFTEDVKRSHFDSSSLPPVKLNGEPHGCKTLYKRSGV
EKVRVAVEELFVLAQLVLQSYRYQNTQSASSLANLLLWLWLLSSTTFRILNLNDKYEKI
QAIVPNLWVSNILIYFFLWFPAVLTFRSALLNHTGDDKLYYIVNFSVITLQIFNLATSKVG
YRCPQVYLSDQHRKPDPEPFTDLLTLVTFSWVTPMMNQAFKVPLTQDDVWDLKMEDF
SYFVLKSFKKFSQGSTLGFSNRVILFFLPFLLVQAFWAVVESLILFAPTILLKRILEFVEDR
NTGNLPLAWFYVTLMFASKFFSNLSSGQALFFGRRVCIRLKSVVIGEIYAKALRRKLTTK
SSSTDQADAGLDKSPSPVSVNPTEEPEEQDKENETKSANLGAIINLMAVDAFKISEVCAY
LHAFFGATCMIIVSIYLLWKLMGWSALVGAFAIIALSPLNFMMSRKLGELQKKALAVTD
RRIQKLNETLQSIRIIKFFAWEKKFEEQILKIRDEELEMLKSRSVIWSFLVVLWCILPTIVT
VISFGCYIFIDKKVLTTPVAFTALSLFNLLRNPLDQISDMLSFAIQSKVSLDRVSEFLSQEE
TTKYEQLTHVKNTGRVGFSKASFSWDSTSDADFKLRDLDVDFTVGKLNVIIGPTGAGKT
SLLLALLGEMEITKGEVHLPGFLPREDLEIGPDGYTESVAYCSQAAWLLNDTIRNNIVFG
SPFNRDRYNKVVSACGLARDFEILKAGDQTEIGEKGIALSGGQKQRVSLARALYSNSRHI
LLDDCLSAVDSHTALHIYENCIAGPLMKNRTVLLVSHNVALTIKSADFVVVLNNGRITN
SGTPEQLLADGALGDDEMIKSTVYSRANSSVDLVQKSKQEEDAVLKVKEALNNMKPIE
NPEDEELENLKKGKLIEEEQKSEGVVSLEVYKWFFSIFGGWFIVAVLLGLFLVANVINFG
QSWWVRKWAKDASNDVHISIAGTLSESQYYGAMSQFIAKPLNVFVFKYHQIQNSMSVL
KETNISVYYIIVYGILGVSYALIVGLRIVYGFFMGIKASRRVFAKVLNKILRAKLRFFDSTP
IGRIMNRFSKDIESVDQDLIPPIDGAVSCAVSVLFTLAMIMAITPGFLIFAILILVMYYLVA
VFYLSSSRELKRFDSITKSPIHQHFSETLVGASTIRAYGIERRFLQENLNKIDENNRPFFYM
WITNRWLSFRNDMIGASVIFLAGAFILFSLDKIDAGLAGISLSYAIVFNDTALWIVRLYAN
VEMAMNSVERLKEYTDVDEEPAEEVPENEPPESWPEHGALEVCDLSLRYAPHLPLVIKN
VSFNVEPSNKIGIVGRTGAGKSTIITALFRFLDPETGYIKIDGVDITSIGLKRLRQSITIIPQD
PTLFTGTIRSNLDPFGNYSDAFIFEALKRVNLITEDELANQGGSSSGSSSSDENANKFLNL
NSDVSEGGGNLSQGQRQLMCLARSLLRDPKIMLLDEATASIDYDSDAKIQQTIRQEFSNS
TILTIAHRLRSIIDYDKILVMDAGEVVEFDHPYKLISDKSTTFYSMCVDSGELDVLTQIAK
EAFKRTV SEQ ID NO: 87 ABC transporter polypeptide sequence
MESTPPDYTGLDPTIDAEIRSIAESVHKDRVDDYDTEKGTVGNEKLLRSDTVQPNLDVN
PYIDNSDPQLDPLSDEFNARKWIKTVLGLKQRFGATKHITAGVSFKNLAAYGYGGGSQY
QKTFSNSVLAIGPMIMELFGGNKGTKVQILRHFDGLVRAGETCVVLGRPGSGCTTFLKS
VACETYGFHIEDKTEWNYQGEYELLRSPL Illustrative Sequences SEQ ID NO: 88 *Kluyveromyces marxianus* ABC transporter polypeptide sequence
MNFGIKSQSEPSNYQPEYHGFDQQVERQVKELARSLSRASIDKQRYPAAFNSHISTNDES
EHDDNKSITSIFSGVHEGVNPVYLDPSAPGYDARLDPNSEHFSSAAWIKNMVAFSMQDP
EYYKHYTIGCCWKDLRAFGDSNDVSYQSTVTTLPGKYLGKIKRHFSATKEEDLFDILKP
MDGLVKPGELLVVLGRPGAGCSTLLKTISANVEGYSIDPNSTISYNGLDPKVIKKHFRGE
VVYNAEGDIHFPHLTVYETLYNVALLATPSNRIKGVSREEFAKHITEVAMATYGLSHTK
NTKVGGDLVRGVSGGERKRVSIAEVTICGSKFQCWDNATRGLDSATALEFIRALKTSTD
ISGSTAVIAIYQCSQDTYDLFDKVCVLDEGFQIFFGYAKDAKKYFENMGYVCPPRQTTA
DFLTSVTNPAERIVNQDYVKEGRFIPSTAKEMEEYWRNSPEYKQLRADIEEELSKDSAKS
LQELEESHIARQSDGQRKGSPYIVNYGMQVKYLTLRNILRIRRSYSITLGTIVSNTCMSLI
LGSAFYKSMKHTTTNTFFFRGAALYISVLFNAFSSMLEIFSLYEARPIIEKHKRYSLYHPS
ADALASMISELPGKFITAVFFNVILYFMANFRREPGPFFFYFMMNFLSTLVMSSIFRCLGS
AAKTLPEAMVPSSVLLLIITLYVGFTIPKKNMLGWSKWLWYINPVSYVFESLMINEFNGR
DFPCAVFIPSGPGYENVSATEKVCNTVGSKPGLPYVSGKDFIVQSYGYDPSHRWRGFGIA
LAYFIFFSAVYLLFCEYNESAVQKGEILVFPKAVLKKAKKEALSRPKSDVETGEDPEGGI
TDRKLLQDSQEDSNESVDEKQSAIALEKSGAIFHWRNVCYDVQIKKETRRILSNVDGWV
KPGTLTALMGSSGAGKTTLLDCLASRVTMGVITGDMFVNGHLRDNSFPRSIGYCQQQD
LHLSTATVRESLRFSAYLRQPSSVSIEDKNRYVEHVIRMLGMEKYADAVVGVTGEGLN
VEQRKRLTIGVELAARPKLLLFLDEPTSGLDSQTAWSVCQLMRKLADHGQAILCTIHQP
SALLMQEFDRLLFLQKGGKTVYFGDLGHGCQTMIDYFERNGAHKCPEGANPAEWMLE
VIGAAPGSSTTVDYHEIWRNSEEYRMVQKELDWMEVELAKKPMDTTEEQKEFGTSLPY
QFKIVTKRLFQQYWRTPSYIWSKVMLTVLPQILLGFTFFKAKLTLQGLQNQLFAIFTFTIV
FSPACEQYLPMFVSQRDLYEARERPSRTFSWLAFIFSQFVVEIPFNVLGTVAFFVFYYPV
GFYNNASYAGQLHERGVLFWLLCIEFYTYISSMGQLCMGGLEHDALAANIASIFFMISLL
FSGVFGGPGVLPGFWNFMYRVSPLTYLMDGLISTGIANTKTQCAPYEFVHFSPREGQNC
GTYMTPFIKSHGGYLQNPEDNSDCRFCRISESNTFLKNYKSDYREDGGTLVYFLCTSFST
GAAVCSCTG SEQ ID NO: 89 *Hansenula polymorpha* ABC transporter polypeptide sequence
MDEKDFYGSPVTITSVLDTSRVTKVSHKPWLFTFVKAKDCWLLLPALIFTILSAMVPAT
VAVLLARVFNKLEGFGRNDYSSSHDFVADVQWFCFAIAFVGIGATLFNWLGLTCFLLV
GERQQKRCRQEVYQSLLRKELEWFDRKSDLNSNLMQVNRCIEEFRMGVSECLEMLIKS
LAMLCALLILSFYYSWRLTLLVMATIPVIVLVTSGWGILIGKYTTLENKHSENTVKVLEW
NLLNYMWIKIVDSSLLEKRKLDAATKLTSHSFLKMKLFFNLNAGMVKFLALMMFIQSF
WYGSFLVRNHLNSSGDIISCFYSCLTVSRIFSTISSQIVSLKTAHISLKYVFKSVDCSNVSY
EGGFQPKHVMMGNIKISNVSFKYPVRDDWGLKNITLQIPANHLLYIVGKSGSGKSTLAS
LILGLYHFDGKITCDDYDISRLDRSWLASQITLVQQQCTLFRGTIFENLSLASPTPVAPKL
LNEALQITGLDQLIASLPGGLNTKLGGGPGSITLSGGQQQKVALCRAIIRDTPVLILDEAL
SAVDYNQRILILEKLKRNRRRSTVIMTHDYSEIADSDYVVLMENGKIEEQGLKIDLLNG
KTRFASLQYQLDTPDNPFEHGIEEEEVGERLDLLHDLESQAHKEVSILQLLRQLWHVLTF
GSRVCFLLGIIVSVVNASMTPLFTFFLSKLILGIVSVGQQVSSTYMVKWSLVLLCVALMD
GLSLFTSKMALSQSSETLVDQLRNRAFDKILVQPVCWFQSANPSALSSLLINDIKDLRTMI
SDAPSQLISVIALILIALVWSLIVCWKLALVGLSFAPLFAMFSILFSIVLQKYETEYKQASD
NVEGVVYESVLGMKTVVSLNLQNHFQARFNNHMNQMNHAGKQRALIISIAMAAQNIAI
YLSQAIMLYYGIKLVSEKSITLVQMMQVVALIMFTVGYVSAMLSSMPNVNKGVLVFMK
ILTLIQLPENLQESYGTAKPIMKPNKPLLKFQNVQFSYDPNSSPVLNNFNFSLYMNEITCI
VGKSGCGKSTLLNLLLRLYSPQKGSIKFCGANLDQLDMSELKKEVAIVTQNHYFFDGTIF
ENLTYNLQKPVTSAQINEVLELVDMAKFVHSLPDNLFSRIGGSSNLLISGGQLQRLCIAR
ALIRSPKVLILDECTASLDPQNTKRVAKIILGLKKHVTIIMISHQREMMQIADTVAYMED
GIIKEKGHYNTLSNRKNLFYQLIN SEQ ID NO: 90 *Hansenula polymorpha* ABC transporter polypeptide sequence
MSEKTSDITKSHSIEPLEYTPFNETGYEDTEENISFTKTHPVSINVHNLQISARKGPKKIFG
RNAKKNSNESTKKQILHPMSFHIPENTLACIIGGSGSGKTTLLNRLAGKQITSSTLIQEGSV
TYNNDSDLSKIRHAYVIQQDILIPNLTCFETLMFAAELKLPKLTSKTARAKLVNEIIMELG
LKECRDTLVGDRVNKGLSGGEKRRLSVAIQLVSNPSLLFLDEPTTGLDSYNAYLLCESL
KRLTKRLDKTIVLSIHQPRADIFRLFDQVYILSKGHMCYGDTYENVFNHFASLGYPIPEN
VNPADFLIDTTSIDSRNPEQEAISSKRVYFIVEQWKQRMAKIELPVYKDKNTDHGDETFQ
KVGRAPFWRELRILIRRNFILERRDPIGYAALLMEAILLGLMTGWLYFKPGSSLVGLRSIQ
GSLYTVSSLQAYLFLLYESYRLCSLDLRVYDRERSEHCISIPGFLLARRIAKLFSEDIIIPLL
FSLCTYFMVGLRTDSSIYFFRFFAANILFHLNSMAFATLAASLTRDVALATLICNLNFTFQ
TMTNGMYVNAKQMPVYVRWCKYVAYQWYSYGLLISNQFTGYRGDCFKEHADSPNVE
DICRAYTGSYITNSLGFWENWIALPFGVLVAFFVGTFVVAGVILKIKPEDVTMAKEVKQ
SESKSATSTEIPRALPQSDQPLDIRVCDVNLYVENKLARRGKKQILNNVSCNFQSGKLNII
MGPSGSGKTSLLNLMSGRLKSTLFTRYSSSGVVYLNDCQTEFDTIRPICSYVVQDDHHLL
PSITVRETLRFSARMRLSKAKLSSSQINALVDRLILQVGLRDCADTLVGNELIKGISGGEK
RRLSIAIQLLSSPKMLILDEPTSGLDSFTASSILECLDHLASSGTTVIMTIHQPRTLEGFGRI
LLLAKGGQVAFNGTQEELVDHFTSIGYPIPKFTNLADYVIDMISYSTTHEEVERRTRERV
RHIVGAWKTENLHLIPRRKLTSKTDLYSEFHAFVKQPVDFVTGLYVLTQRQILSLIRDKN
ILFARCTQVIGMGVILSLFFARLKHNNTSIQNRLGLIQQIVSIYFTGMLNNMAAYPRERDF
FYEEYTDDATNLYSFFVSYTLIEIPFEIFNALVFSVPLVFVVGFQYDVGLFFTMVYTSALV
INAGESVGLSFNTMFDHPGFALNVISIICSVGVAMAGLLAMTLDSFLRALNYLSPAHYCV
MSISNLVFTKKLKLYCTDEERVNNGQCLFNTGEDVMESYNLKVNLKLYLILIVIVTICHR
LIPLVLLRLKLVKFSVMRPGHSSS

|                        Illustrative Sequences                         |
|-----------------------------------------------------------------------|

SEQ ID NO: 91 *Kluyveromyces marxianus* ABC transporter polypeptide sequence
MTDISVRTKVLKLLVQLHYQFLKLDLRKVQLKGYVPALLRHCWTLLRSADVSDSRNRG
FKRHARFVIWAFAAICGGSGISLAIAVNRVIKICTRRRTRNLVSSSAKNQNLQNGTRELYI
KEDGGKEKKVLVVPTDSDQYEHDRYLFKNLGNNVESQLFSSKFLQQLNVLSPILIPKFLH
KNSLLLASQIFFLILRTWLSLMVARLDGQIVKDIISRRPKRFAYDMTCWLLIAFPASYTNS
AIKYIQRKLSLNFRLRLTRYIHDMYLDKRLVFYKTSFDHEATNSIIRNIDNSITNDVQKFC
DAITNVFANIAKPMIDLIFFSIFLRDSLGTLGVAGIFFNYFSTGYILRKYSPPLGKFVSLKSK
SEGDYYNYNLNMINNSEEIAFYQGTEVEHSKVNELYDKLMDHMLLVDRSKVEYNIVED
YILKYTWSAWGYAFASIPIVIQTWASDAVNESGNMKEFIMNKRLMLSLADAGTRLMHSI
KDISQLTGYTNRIFTLLKVLHRVHDSNFDYGVLHDGEEPSAAELNSIIGNGVTKSSPAIRG
TVQHDFGGIRFENIDIIVPSSKGVNGSLLVKSLTFQIPQEIAPEPASSKQISLTNIRDPFDAS
KLINQRGMGSSLLILGPNSCGKSSIERILTEIWPIYNKNGLLSVPPAHDLFCVPQRPYFTQG
STFRDQIIYPMSYEEFYEKGFKDSYLKQILREVRLDYLLKRDRGLNYFDAVTDWKDILSG
GEKQRVNFARIMFHRPRFVVLDEATNAISTDMEDHLFTMLKRYRFNFISISQRPSLIKYH
DYLLELTSGTNWNLQTLGSDEAILTIEHEIDSIQQKLSNVKSSEKQRDEIQRKLNMM SEQ ID NO: 92 *Hansenula polymorpha* ABC transporter polypeptide sequence
MLRNLLLALCLVGPLGAFSRNSDFSTFIKGDWQQLQDNMLDQLATNAIGDSAPDKDDK
CPPCFNCNLPNFECKQFSKCNPFSGRCECLDGFGGDDCSVPLCGALPDGSNRPKREVNE
TCHCEEGWGGINCNLCQIDSVCDAFVPGGLKGTCYHSGILVNRNFQMCDVTNSKILEVL
NGKKPQVTFSCNKTAEKCNFQFWIAEEESFYCDLSKCKFNYDLGANTTHYNCEDVACK
CLPGKMLCGQAGSIDISDFLTETIAGPADFSCDVAHKDCKFSEPSMNDLITNVFGDPYITL
HCESGECLHESEIPGSDQPGKPKFGVIDVLRIIGTIVGCAAIIGLGFYGIKRSPLFMDEGTV
QLPPDDNPDLQDSLLDDYKPAIFSFENVSYTVAGKKVLNNAFGLVEPGECMAIMGGSG
AGKTTLLDIIAGKNKGGEASGTFYVNGERITTKQDLMHFQKSVGFVNQEDFLIPTLSVYE
TVLNSALLRLPKNMSMATKKAKVNQILAELRILHIKDKLIGSDFERGISGGEKRRVAIAC
ELVTSPSILFLDEPTSGLDGYNAFNVVECLVRLAKDYNRTVIFTIHQPRSNIVALFDKLML
LSEGQLVYSGLMSDCSNFFAGNGYVCPAGYNIADYLIDITSGGSPIAMLSPVDGENHEH
DIHTLLPANDVDDPTGEWQHYASHRDEFGNRVKSAGATSKASSAAVASIFEQSLNAERL
HLDIKELAEKFNNAQQDNNSAGSFFKSQGGKTRAGFWTQLTILCSRTFKNSYRNPKLLM
SHYALALIMGLFCSYLYYDVENNISGFQNRLGLFFFLLTLFGFSTLTGLHSFSVERLVFVR
ERSNNYYHPLSYYVSKLLCDVIPLRLFPPVILMAIIYPLVGLNMEGNKFWLSMLILVLFN
LAASLEILIIGILVKEPGSATMVGVLVLLFSLLFAGLFINKDTIPVQISWFENISVFHYGYE
ALAVNEVNGLVLKEKKYGLDINVPGAVILSTFGFDVGAVGFDICWLAGMFGAFVVLGY
LGLHYFVYETR SEQ ID NO: 93 *Saccharomyces cerevisiae* ABC transporter polypeptide sequence
MAGILSKTLSEVHPSLRTNGMGIGNTHRRISLGFLPPNKKNPLVRKFRARTRNIDQRSFRS
LTDDFGSNVHEPNPYLGNIDEEPDLYYHDEEDGELSRTISLPSRVSETPELSPQDVDWILH
EHERRYSSVCNSDNEEASQSNTPDRIQEYSGRELEYDEFMNRLQAQKQKLTRSAVTDAK
GTSHHRRPSFVSVTSRGSVPTIYQEIDENDSEALAELAHSHVTFKSEARVLASYSFPLIFTF
LLEQIFPMVCSLTVGHLGKNELAAVSLASMTSNITLAIFEGIATSLDTLCPQAYGSGRFYS
VGVHLQRCIAFSLVIYIPFAVMWWYSEPLLSYIIPEKELINLTSRFLRVLILGAPAYIFFENL
KRFLQAQGIFDAGIYVLTICAPLNVLVSYTLVWNKYIGVGFIGAAIAVVLNFWLMFFLLL
FYALYIDGRKCWGGFSRKAFTHWNDLGHLAFSGIIMLEAEELSYELLTLFSAYYGVSYL
AAQSAVSTMAALLYMIPFAIGISTSTRIANFIGAKRTDFAHISSQVGLSFSFIAGFINCCILV
FGRNLIANIYSKDPEVIKLIAQVLPLVGIVQNFDSLNAVAGSCLRGQGMQSLGSIVNLMA
YYLFGIPLALILSWFFDMKLYGLWIGIGSAMLLIGLVEAYYVLFPDWDKIMTYAEILKET
EDDEVDSDEYLTDSDDPDENTALLGA SEQ ID NO: 94 *Saccharomyces cerevisiae* ABC transporter polypeptide sequence
MNRILSSASLLSNVSMPRQNKHKITKALCYAIIVASIGSIQFGYHLSELNAPQQVLSCSEF
DIPMEGYPYDRTWLGKRGYKQCIPLNDEQIGIVTSVFCIGGILGSYFATSLANIYGRKFSS
LINCTLNIVGSLIIFNSNSYRGLIIGRILVGISCGSLIVIIPLFIKEVAPSGWEGLLGSMTQICI
RLGVLLTQGIALPLTDSYRWRWILFGSFLIAVLNFFMWFIVDESPKWLLAHGRVTDAKL
SLCKLRGVTFDEAAQEIQDWQLQIESGDPLIEPTTTNSISGSNSLWKYLRDRTNVKSRHVI
TVLLFGQQFCGINSIVLYGTKIISQLYPQHAIRINFFISMVNVLVTILVSLLIHSLPRKPLLM
TSTVLVSVTAFIMGIAMNHNKMNLLIVFSFIYMGVFTMGLNPLPFIIMREVSKPQDMVLA
QRYGTICNWVGTFIIAYTFPIIHDVLSGYVFIIFAIIACSISAFIWKKVPETKRSG SEQ ID NO: 95 *Yarrowia lipolytica* ABC transporter polypeptide sequence
MDRLKTSAVGQKVVSYVSARSPVWGATYLRHRSKILWSIYMVLFLSNFAGVGSKRSKK
KARKEEKEEERKAEREVLGSANAIPEKKVKSEINREFFLKPKRVIKVMFPNGLRSKEFWL
LCLHTMFLIMRSVISLYVANLDGKLVSDLVRGKGRAFLWGIVWWMVVSVPATFTNSIL
SYLQCILALRYRNNLTQHIVGEYLPESGNPVYYSIHNLDDRIKNADQLIAVDVQRLSHSV
SHLYSNLAKPTLDMFLYSWSLSRNLGGEGMLLVGFLIQGSAVVMRALTPPFGRYAATE
AALEGEFRFEHTRLIEYAEEVALYNGQEHEKTILDKGYFALIKHKNRILVRRLYHSFMED
FIIKYFWGALGLALCSIPIFFKVPGVDVASAAASGSRTEKFVTNRRMLLSCSDAFGRIMFS
YKEIAQLSGYTARVVALMDVMEDIKHGNFDKNQISGKQVDARHEKTLASVTESSLVKT
RYSDPSEASGKTIIGSDIIFDRVPVVSPSGDVLVPELSFEVKYGRHLLIVGPNGCGKSSLFR
ILGGLWPVYAGTLTKPPSSDIFYIPQRPYLSRGTLRQQVIYPSTEAENKTSDKELEEILKIV
KIDHIVEAVGGWDAEREWREDLSMGVQQRIAMARLFYHKPKFAILDECTSSVTADMEY
VMYTHSQELGISLLSVSHRTSLWKYHDLILQFDG QGGYLFGDLDPEERLKVEEESRQLD
AYIRSVPDMEERLAMLKASVAQ

| Illustrative Sequences |
| --- |

SEQ ID NO: 96 Hansenula polymorpha ABC transporter polypeptide sequence
MNTEQAFEKHLALQRRPLTFLLSKNVPPLPLQEERKTFPHYKTNPLYRCFFWYLTPLLR
VGYKRTLQPEDLFVLDEQQTIDYMYTKFKSTFEPEVEKLLAQHIARKCQERGETPETSSV
SPEEDADDFEIKVSVLGKHLFYTFGWQYSRAAFVKVLADIAGTLMPLLQKKLVDFVETR
GYGASTNTGKGVGYAIGACAMILFSGICINHYFYNSITTGAKVKAVLTKALLEKSFKLD
ARGKHRFPVGKINSIMGTDLARVDLAIGFFPPLFIFPPIPVIIVVVMLIVNIGVSALAGIAVFV
FFTLFTGFLIRYLFKLRVSANVFTDQRVNLIKELLKNFKMIKLYGWENSYLRSFQKIRSQE
MSTLFKMQGGKNVLIGISLWMPLAASMVAFLVHSLKSSRSVGDIFSSLTLFQVLTQQFL
LVPASLAMSSDMVIGLKRVCQLLSCPEDKELDKFFDDLDDEKLAMKIENASFQWHTFE
DDETEDKNESVKSTKSTKSSTMSEEQEVVEKESHEREELSKTDFPGLLNLNLSIKKGDFV
VVTGSVGSGKSSLLNALCGFMPKTEGRVCKNGSVMLCGAPWVQNATVKDNITFGRPFD
QEKYDSVVKVCSLKGDFDQLPGGELTEVGERGITLSGGQKARINLARAVYADRDIIMLD
DVLSAVDAKVGKFIMDECILGYLRDKTRILATHQLSLIGSADKIMFLNGDGSVDCGTFA
ELRSRNTEFVRLMEFSHDVEKDDDEETLENEKKGFFDDEDKGKLVQAEEKAVNAISWQ
VYKSYINTGSGKLRALLPMLFFLVIALTTFLTLFTNNWLSFWIVDRFHRPKKFYEGIYIMF
TMLVMVFNVLQFMILVYFCNRAALRLNIMAFKRVLHAPMSFMDTSPMGRVLNRFTKD
TDALDNEIQDQLRMFLNPAATIIGTLVLCIIYLPWFAIAIPFLAMLFFLVSSFYLSSSREVK
RLEAVKRSVVYSHFNEALSGMDTIKAHGSTERFLKVNEKLIDDMNESYYVVVAIQGWL
AISLDSVATLLCLIVALLCCFRVFNISGAYTGLLLTYVLTIAGLLSFMLRSLTEVENQMNS
VERVNYYATSIKQEAPFEIPENDPEPSWPAVGAVKFIDVSMRYREELPLAVKHLDINVRG
GEKIGICGRTGAGKSSIMYCLFRLAEFEGQILIDGVDISRIGLHKLRSRLSIIPQDPVLFSGT
VRSNLDPFGEHDDETLWTSLGKAGLIDRDLLPQVKEQSKGDPNLHKFHLSRTVEDDGSN
FSLGEKQLIALARALVRGTKILVLDEATSSVDYETDAKVQTTITKEFSDCTVLCIAHRLK
TIVKYDRILVMDKGQIAEFDTPRKLYDQKGIFRSMCNKSGVSEADLK SEQ ID NO: 97 Saccharomyces cerevisiae ABC transporter polypeptide sequence
MECVSVEGTATSFLEGQTFGDILCLPWTIIKGIRERKNRNKMKIILKNVSLLAKSGEMVL
VLGRPGAGCTSFLKSAAGETSQFAGGVTTGHISYDGIPQKEMMQHYKPDVIYNGEQDV
HFPHLTVKQTLDFAISCKMPAKRVNNVTKEEYITANREFYAKIFGLTHTFDTKVGNDFIS
GVSGGERKRVSIAEALAAKGSIYCWDNATRGLDSSTALEFARAIRTMTNLLGTTALVTV
YQASENIYETFDKVTVLYAGRQIFCGKTTEAKDYFENMGYLCPPRQSTAEYLTAITDPN
GLHEIKPGFEYQVPHTADEFEKYWLDSPEYARLKGEIQKYKHEVNTEWTKKTYNESMA
QEKSKGTRKKSYYTVSYWEQIRLCTIRGFLRIYGDKSYTVINTCAAIAQAFITGSLFYQAP
SSTLGAFSRSGVLFFSLLYYSLMGLANISFEHRPILQKHKVYSLYHPSAEALASTISSFPFR
MIGLTFFIIILYFLAGLHRSAGAFFTMYLLLTMCSEAITSLFQMVSSLCDTLSQANSIAGV
VMLSIAMYSTYMIQLPSMHPWFKWISYILPIRYAFESMLNAEFHGRHMDCGGTLVPSGP
GFENILPENQVCAFVGSRPGQSWVLGDDYLRAQYQYEYKNTWRNFGIMWCFLIGYIVL
RAVFTEYKSPVKSGGDALVVKKGTKNAIQRSWSSKNDEENLNASIATQDMKEIASSND
DSTSADFEGLESTGVFIWKNVSFTIPHSSGQRKLLDSVSGYCVPGTLTALIGESGAGKTTL
LNTLAQRNVGTITGDMLVDGLPMDASFKRRTGYVQQQDLHVAELTVKESLQFSARMR
RPQSIPDAEKMEYVEKIISILEMQEFSEALVGEIGYGLNVEQRKKLSIGVELVGKPDLLLF
LDEPTSGLDSQSAWAVVKMLKRLALAGQSILCTIHQPSATLFEQFDRLLLLGKGGQTIYF
GEIGKNSSSVIKYFEKNGARKCQQNENPAEYILEAIGAGATASVQQNWPDIWQKSHEYA
NINEKINDMIKDLSSTTLHKTATRASKYATSYSYQFHHVLKRSSLTFWRNLNYIMAKMM
LLMISGLFIGFTFFHVGVNAIGLQNSLFACFMAIVISAPATNQIQERATVAKELYEVRESK
SNMFHWSLLLITHYLNELPYHLLFSTIFFVSSYFPLGVFTEASRSSVFYLNYAILFQLYYIG
LALMILYMSPNLQSANVIVGFILSFLLSFCGAVQPASLMPGFWTFMWKLSPYTYFLQNL
VGLLMHDKPVRCSKKELSLFNPPVGQTCGEFTKPFFEFGTGYIANPDATADCAYCQYKV
GDEYLARINASFSYLWRNFGFI SEQ ID NO: 98 Pichia pastoris ABC transporter polypeptide sequence
MSSTSSSINDKDKESSNIDSPKDTVPYEPTRFVGDLENQNEDDIYSEQLSRILTQSEAVQKI
QSLARTMSRMTKKELAAFEVNQDDFDLKILLHYLRAKSEEQGIESCSAGVAFKNLTATG
IDVSAAYGPTVDEMLRNFFMWPIRFAKREHVKTRQIIRNFTGSIEAGELCLVLGRPGAGC
STLLKCCTGNTSELLSVEGEFSYDGLDQAEMMKDYKGYVIYNPELDTHFPHITVKQTID
FALKMKTPAKRVDGIPRKKYIDTMRDLWCTVFGLRHTYGTKVGNDFIRGVSGGERKRV
SIVEALATGASVYAWDNATRGLDASTALEFTQAIRTSTNLLNASGMVAIYQAGENIYEL
FDKVCVLYNGKQVYFGPAEKARKYFEDMGWYKPPRMTTPEFLTAVTDPSGRFIREGFK
NKVPENSEDFEQYWLNSPEYQECLRSHDQYIQDHNPEETRQRLATAKSQTRQKAVRSK
SRFVASYPNQIAYCVTRGFQRTKGEIAYTLVYLSSFLTKGFIVGSMYWNIPKDTSGLFSR
SGILFYCLLFCAVTSLSEISHTYTNRPIILKQKSYSLYHQSAESLQEIITELPTKLVAVIILAL
TTYFMPGLRLSDGGSAFWMYLLFLLLIQQCMSFMFKLIATLTRDAGTAHACGGLLALM
MCVYTGFIIPLPYMHHWIKWFNWINPMRYCYESLLATELHSREMKCSEYIPNGPDYEGI
SMENSACTTTAYNHTTGLVSGNAFLTATYNYRYSHVWRNFGINIAWTAGFIIINTILSEF
VKNVEGGGDMLLYKRGHMPKEGIEAVDGKVASKQEMMEALNGPDVDLKKVIAERDV
FTWQHLDYVIPYGGATRQLLNDVQGYVKPGTMTALMGESGAGKTTLLNTLSQRINFGT
ITGDIFVNGRPLDSSFKRRTGFVQQSDLHLAEYSVRESLRFAVNLRQSEKVPQAEKYEYV
EKIINLLGMQNYAEAIIGKIGRGLNVEQRKKLSIAVELVAKPSLLLFLDEPTSGLDSQSAW
SIIQFLRALSDSGQAILCTIHQPSATLFEVFDRLLLLKKGGRTVYFGDIGPNSSTMLSYFER
ESGIKCGVSENPAEYILNCIGAGATAHASADWGDLWVSSPEHAAVTEEISRLNTELQKRP
LPENIEDLQSKFATSYPHQIKILFLRTMVQFWRSPVYIRAKPLEAVVCAIFVGFSFVKVGH
GLQEAQFGLTSIFMMLIISLAMINQMHVFAFDSRELFEARESASNTFHWSTLLLAQTWW
ETIWCMACQFLCFVCYYFPAGFSGTAHHAGYFFLQFVIIFPIYYCSYGLWVLYFSPDVPS
AGMINSNFFAAMLLFCGVLQPPQFMPGFWTFMYKLSPYTYFVQSFVAPLVHNRKLVCR

| Illustrative Sequences |
|---|
| TNEYTLITPPEGQTCSEFLDPFIESDGGYLGNPDATESCEYCPYTYQSQVMEQFNIKWSY<br>RWRNFGFFFAYIIFNYVALLSCYYLMRVKVWNMKSILNFKKWFNGPRKERHDPETNIFA<br>AQPADAKLAVLKKKE<br><br>SEQ ID NO: 99 Vanderwaltozyma polyspora ABC transporter polypeptide sequence<br>MLIGHTSSDSSSAGGDNNGAGNLRNADYDEKDYDKNGLSFQRSVNLSTLNSKSDASTDI<br>SYRFLPSGEYKVEANKPKTFLNQDDLEKVTDSEIYPQKRLFSFLHSKKIPPVPQDDDERKI<br>FPLYHANIISRIFIWWVFPIIKVGYKRTIQPNDLFITDKKMSIDAIYKSFEKNMNFYFEKYR<br>NEYKKLHPDATDQEVVENTELPRFTVLRALFFTFKYQYLWAVTCAILSNCASGLNPLLT<br>KRLIEFVEAKALVPSLHVNKGIGYAFGACIMIFVNGVFFNHFFCASQLTGSQAKSVLTKA<br>ALSKMFRANGYAKHKFPNGKVTSFVTTDLARIEFAISFQPFLAGFPAALAICIVLLIVNLG<br>PIALVGIGVFFASFFFSLFVFKQIIGLRVTSLIFTDARVTMMREILNNMKMVKYYAWEDA<br>YEKNITDIRTNEIDKVRKMQFIRNFMIALAMSLPNIASLVTFLAMYKVNSSGRTPGNIFAS<br>LSLFQILSLQMFFFPIAISTGIDMILGLDRFQNLLEAPEINQKLLDEMAPTSDIDPNTALRM<br>KNASFEWPDYEKIDAEQEAKQKDKNKNKKDKVKKKEESKKPSAKESSPVDLEKFAFSG<br>FKDINLEIHKGEFIMITGPIGTGKTSLLNAMSGLMEKTEGSVQINGELLMGGYPWIQNAT<br>VRDNIIFGSPFDKSKYNMVVKACCLDADLDILPAGDMTEIGERGINLSGGQKARINLARC<br>VYKNKDIYLFDDVLSAVDSRVGKLIMDECLLGLLNGKTRVLATHQLSLVENASRVIVLG<br>NDGSVDIGTVEELKKRNQTFITLMEHTTQKQDEDEEQDEEFEIEVKELSELEKNLTKVTT<br>KSEVDGHIINKEERAVNSIGWYIYKSYLKAAVGKWGFLVIPLYVFCVTATTFCSLFSSVW<br>LSFWTEDKFPTRSTSFYMGLYSFFVFGGYIFMTSQFTIVCFIGVNASKKLNLSAVRRILHT<br>PMAFLDTTPLGRILNRFTKDTDSLDNELTENVRLMLAQFANIIGVCVMCIIYLPWFAIAIP<br>FILLIFVLVSNHYQSAGREIKRLEAIQRSFVYNNLNEVLGGMDTIRFYNSEERFMAKSDY<br>LIDKMNEAGYLVVCVQRWVAVLLDMIAVCFALIIALLCVTRQFHISASSVGVLLTYVLQ<br>LPGLLNTVLRALTQTENDMNSVERLVSYATELPTEAAYRKPESSPDPSWPQEGKIDFEEV<br>SFAYRPGLPAVLKNLSMSINGGEKIGICGRTGAGKSTIMSALYRLNELESGRIIIDGVNISN<br>IGLFDLRRSLSIIPQDPVLFRGTIRKNLDPFGERSDDELWDALSRGGSIDKESLEEVKTQKS<br>TGNSKVQELHKFHLDQEVEEEGSNFSLGERQLLALARALVRNSKVLILDEATSSVDYET<br>DNKIQNRIIEAFSECTILCIAHRLKTILNYDRILVLEKGEIAEFDSPYNLYKMDGIFTSMCM<br>RSGITEEDFKLK<br><br>SEQ ID NO: 100 Yarrowia lipolytica ABC transporter polypeptide sequence<br>MDRLKTSAVGQKVVSYVSARSPVWGATYLRHRSKILWSIYMVLFLSNFAGVGSKRSKK<br>KARKEEKEEERKAEREVLGSANAIPEKKVKSEINREFFLKFKRVIKVMFPNGLRSKEFWL<br>LCLHTMFLIMRSVISLYVANLDGKLVSDLVRGKGRAFLWGIVWWMVVSVPATFTNSIL<br>SYLQCILALRYRNNLTQHIVGEYLPESGNPVYYSIHNLDDRIKNADQLIAVDVQRLSHSV<br>SHLYSNLAKPTLDMFLYSWSLSRNLGGEGMLLVGFLIQGSAVVMRALTPPFGRYAATE<br>AALEGEFRFEHTRLIEYAEEVALYNGQEHEKTILDKGYFALIKHKNRILVRRLYHSFMED<br>FIIKYFWGALGLALCSIPIFFKVPGVDVASAAASGSRTEKFVTNRRMLLSCSDAFGRIMFS<br>YKEIAQLSGYTARVVALMDVMEDIKHGNFDKNQISGKQVDARHEKTLASVTESSLVKT<br>RYSDPSEASGKTIIGSDIIFDRVPVVSPSGDVLVPELSFEVKYGRHLLIVGPNGCGKSSLFR<br>ILGGLWPVYAGTLTKPPSSDIFYIPQRPYLSRGTLRQQVIYPSTEAENKTSDKELEEILKIV<br>KIDHIVEAVGGWDAEREWREDLSMGVQQRIAMARLFYHKPKFAILDECTSSV<br><br>SEQ ID NO: 101 Saccharomyces cerevisiae ABC transporter polypeptide sequence<br>MLLLPRCPVIGRIVRSKFRSGLIRNHSPVIFTVSKLSTQRPLLFNSAVNLWNQAQKDITHK<br>KSVEQSSSAPKVKTQVKKTSKAPTLSELKILKDLFRYIWPKGNNKVRIRVLIALGLLISAK<br>ILNVQVPFFFKQTIDSMNIAWDDPTVALPAAIGLTILCYGVARFGSVLFGELRNAVFAKV<br>AQNAIRTVSLQTFQHLMKLDLGWHLSRQTGGLTRAMDRGTKGISQVLTAMVFHIIPISF<br>EISVVCGILTYQFGASFAAITFSTMLLYSIFTIKTTAWRTHFRRDANKADNKAASVALDS<br>LINFEAVKYFNNEKYLADKYNGSLMNYRDSQIKVSQSLAFLNSGQNLIFTTALTAMMY<br>MGCTGVIGGNLTVGDLVLINQLVFQLSVPLNFLGSVYRDLKQSLIDMETLFKLRKNEVK<br>IKNAERPLMLPENVPYDITFENVTFGYHPDRKILKNASFTIPAGWKTAIVGSSGSGKSTIL<br>KLVFRFYDPESGRILINGRDIKEYDIDALRKVIGVVPQDTPLFNDTIWENVKFGRIDATDE<br>EVITVVEKAQLAPLIKKLPQGFDTIVGERGLMISGGEKQRLAIARVLLKNARIMFFDEAT<br>SALDTHTEQALLRTIRDNFTSGSRTSVYIAHRLRTIADADKIIVLDNGRVREEGKHLELL<br>AMPGSLYRELWTIQEDLDHLENELKDQQEL<br><br>SEQ ID NO: 102 Scheffersomyces stipitis ABC transporter polypeptide sequence<br>MEVRLESGSELVRQNRLLSFLLSKNVPHLPTDEERKIYPEGTTNFFYRFFFWWLNPVMR<br>TGYKRTLEPQDLFKLSDDIKIENMANRFYHYFERDLERARTKHVEKKCKERGETLATTK<br>VDPEEDLKDFELSKFTTVFALFKTFKYQYSAACVFLCMANSASTCNPLLLKKLIQYVER<br>KALGVEEGIGRGLGYSFGASAIVFLIGVSINHFFYRSMLTGAQAKAVLTKALLDKSFRLS<br>AEAKHKYPVGKITSMMGTDLARIDFAIGFQPPFLIIFPIPIIIAVAILIVNIGVSALVGVAILAF<br>FFCAIAVSTRKLFAYRFTANKFTDARVDFIKEALNNLKIIKFYSWEPPYHENISDIRRKEM<br>RIIYRMQVLRNIITAPSMCLTLFASMISFLVLYAVDKNRKDPASIFSSISLFNVLTQQVFLV<br>PMALSSGADAYLGIGRVGEYLSSSETNLEETRIHADGEKLIEMDKENVAIEIDGAHFEWD<br>TFDDDEEEDLDDEDDKDKAEEGHDEKPKQALSASAKHHTHKETFLEKKDSTKTFVPFP<br>GLTNINLTINKNEFVVTGLIGTGKSSLLNAMSGFMRRTSGSVNVDGELLLCGYPWVQN<br>ATVRDNIVFGSEWDEEKYNNVIYACSLESDLEILPAGDQTEIGERGITLSGGQKARINLA<br>RAVYAERDIILMDDVLSAVDARVGRHIMNNCILGLLKDKTRVLATHQLSLIGSADKVVY<br>LNGDGTIDVGTFEELKARNISFANLMAYNSEAKEEEEEEEEVEEDEEVVENEREMIQRQLS<br>KVTKPEDEEAEHKDFNKNEHRDGHLTEQEERAVNGINAEVYQQYIKLGSGKFSPWLFC<br>PLLVSLMILSTFCQLFTNTWLSFWTEFKFTNKSNGFYIGFYVMFTVLSFILLTCEFVMLVY<br>LTNTASVRLNIMAIEKVLHAPMAFMDTTPMGRILNRFTKDTDVLDNEIGDQLRFLVFVF<br>ANIIGVLILCVIYLPWFAIAIPFLGFLFVAVANYYQASAREIKRLEAVQRSFVYNNFNETL<br>SGMNTIKAYNAEYRFLEKNNELIDNMNEAYYLTIANQRWLAIHMDIIATIFALLIALLCV |

| Illustrative Sequences |
| --- |
| NRVFNITAASVGLLLSYVFQIAGQLSMLIRTFTQVENEMNSAERLASYAFHLPEEAPYLI
NERTPAPSWPDKGIVKFDNASLAYRPGLPLVLKNLSFEVKPSEKIGICGRTGAGKSSIMT
ALYRLSELESGKITIDDVDIASLGLKDLRSKLSIIPQDPVLFRGSIRKNLDPFNESSDSKLW
DALVRTGLIDPSRLDIVKKQVKTQSTEDEEGSIIHKFHLDQQVEDEGSNFSLGERQLIAFA
RALVRDSKILILDEATSSVDYETDFKIQTSIIKEFSQCTILCIAHRLKTIINYDRILV
LDKGEIKEFDTPWNLFNISNGIFQQMCQKSNITEEDFANLKNF SEQ ID NO: 103 *Candida pseudohaemulonii* ABC transporter polypeptide sequence
MSVPVIPTTPIARKRLVNASFDNYNEEEDPTFVDEPTEVSDSEDLISVISNVLLSDDDSVE
TKGGNGDIKNLSTPAQKETWKEWAIRHEVPRKLLHLLIGPFSLWLYTLGATMNQILWPL
VFLTAVLFINDYVRLHNPEVNKVMTRVFGLILRQSEINGYNGTLFYALGVLLVFTSAPK
DIAVMAVLLLSWADTAALTVGRLWGKYTPKVMPGKSLAGCLASFATGVFLCYLFYGY
FCVAYAHVNKPGMIFWTEETSKMSLHVYAIATGLAASILEASDIGGIDDNFIIPVMSAILL
YVLKRLLTPFLSKKVPPIPYEDERIVYPKRPNFISAVFFWWLHPVMSTGYKRTLQTQDLY
RLNDENEVAAMTARFEGIFERRLSNSRRKHIAAKCKARGETPETSSVPAEEDLADHQPP
KMLCAWAILETFKWQYGLACLYNTLANTASVTNPLLSKRLIQFVEKHALGLDTQVGKG
VGYALGASFMVLLIGILINHGFQNAMLTGAQVKGVLTKAFLDKSFRLSDRARHDYPGS
KITSMMGTDLARIDFALGFQPFLVSFPVPTAVAIGILIWNIGAPALVGIGLVFVFLFAIMVL
TGKLFQYRKKANKYTDARINYIKEVLNNLKIIKFYSWEEPYNDVIGENRSKEMNIIYKM
QVGRNIILSLAMCLTLFASMASFLVLYATAGSTKDPASLFSSISLFNSLAQQVIMLPLALA
TGSDALVGIFRAAQFLSAEEVDANATAIYAPPDVQDEMDYQNLAISLKGACFEWETFDQ
NDDDEEENDEKNPESKKDSKNEKGTIEELQADNKLSLSTNTAKESEVEPKLTTYSTGDS
TMEATIFSGLSNINLDVQKNEFIVITGLIGSGKTSLLNALAGFMKRVSGSVDVNGSLLLCE
TPWIQNATVRENILFGEEFDQEKYDSILFACSLESDLEILPAGDKTEIGERGINLSGGQKA
RINLARAVYANRDIVLLDDVLSAVDARVGKHIMNNCILGLLKDKTRILATHQLSLIGAA
DRVVFLNGDGTVDIGTFDELKKSNPGFDHLMKFSSESAEEEEEETLPEEALGEDPEVEDR
EMIQRQLSQKQSTVPDEEAERHNYNVNEQQDGRLMSQEGRAVNRIKGVVYKNYVKYG
SGVFKLYSGVPIVITLTIFAIFCQLFTNTWLTFWSEPKFDGKDNGFYIGFYVMFTVLAFIFL
SSEFVIVAYMTNEAAKVLNLKAVSRVLRAPMSFMDTTPMGRILNRFTKDTDTLDNEIGN
QIRMLIYFLSNIVGVIILCVVYLPWFAIAIPFLGMIFVSVANFYQASAREIKRLEATQRSFV
YNNFNETLSGMNTIKAYNAQERFKKKNSTFIDNMNEAYYLTIANQRWLAIHLDIIAMLF
AIIICFLCIFRVFDIGAAATGLLLSYVLQIAGQLSMLVRTYTQVENEMNAVERICEYAFHL
EQEAPYTFENSNLPATWPEQGSISFVNASLAYRPGLPNVLKSLNMDIKPLEKIGICGRTG
AGKSSIMTALYRLSELNEGMIEIDGVDISKLGLRDLRSKLSIIPQDPVLFRGSIRKNLDPFG
ASPDDDLWDAMRRAGLIESSKLSTIKNQTKSSDNLFKFHLDREVEDNGSNFSLGERQLIS
FARALVRGSKILILDEATSSVDYETDSKIQETIQREFTDCTILCIAHRLKTIVNYDRILVLD
KGEIKEFDTPWNLFNLKHSIFQQMCEKSSITKDDFAHKG SEQ ID NO: 104 *Candida tanzawaensis* ABC transporter polypeptide sequence
MSDNEAAQLHSQKRLLTKFLSKRIPHLPSPDERPPYPSSTANVFSKVFFWWLHPVMRTG
YKRTLEPEDLFTLTDDIKVEKMAADFYRHFTAGVAKAETKHIAAKCKARGETPATSSVS
SADDLADFTVSKYVTVWALFLTFKWQYSMSCLFLSLSSVGQTTNPLLTKKLITFVERRA
LGIETSINKGLGYSFGSCLVIMMVGIFINHFFYRSMLTGAQAKAVLTKAMLDKAFRLNA
ESKHKYSVGKITSIMGADLARVDFAFGFQPFLFTFPIPVAIAIAILVVNIGVAALVGVALV
VLFLVFIFTLAKRLFGLRFKAMKFTDLRVNYLKEALNNLKVIKYYSWEAPYEANIADAR
HKEMKIIYKMQVMRNILIAVAMSLTLFSSMIAFLVLYAIRTGNRSPADIFSSISLFNVLSQ
QVILLPMALSSGTDALLGITRVGEFLCADELDPEELRIEADGPKREQMEKENLALEVQNA
SFEWETFDLDDNAEEANEKKQEKVAKTDSSDKDEKYESESDASSEIVFSGLHNIDLKIQK
NEFVVITGLIGSGKSSLLSALSGFMKRTQGAIDVNGSLLLCGYPWVQNATVKENIIFGNE
YDEQRYKDTIYACSLEADLDVLPGGDATEIGERGITLSGGQKARINLARAVYADKDIILL
DDVLSAVDASVGKHIMNNCLLGMLKDKTRILATHQLSLISAANRVIFLNGDGSVDIGTT
SELKERNPGFEKLMAFSSEQKDEEEDEENIEEELDVIEGAPKKSKKENRADEEAIHKTYK
NDTTGGKLTEEEERAVNGIKFEVYANYANEGSGKVGPWVVVPSYLLLMILATFCQLFT
NTWLSFWTEYKFKDKPDKFYIGIYVMFTVLSFVFLLSEFIVLVSLSNSAAINLNIRAVKRI
LHAPMSFMDTTPMGRILNRFTKDTDVLDNELGDQARFLMFTLSNIIGVLILCVIYLPWFA
IALPFLGFLFVAVANFYQASAREIKRLEAIQRSFVYNNFNETLSGMPTIKAYNAEARFVA
KSDNYLNVMNEAYYLSIANQRWLTLHMDILAAIFALLICLLCVGRVFSISPASVGLLLAY
VIQIANQLSLLIRTFTQVENEMNSVERLSQYAFGLPEEAPYVITETTPKESWPEQGEITFK
DVSMAYRPGLPLVLKDLSFQVKPAEKIGICGRTGAGKSSIMTALYRLTELEKGSIVIDGV
DISNLGLHALRSKLSIIPQDPVLFRGSIRKNLDPFNERSDDKLWDALRRTGLIDSTRLEAV
KKQVKTDDTDDESAMHKFHLDQSVEDDGSNFSLGERQLIAFARALVRDSKILILDEATS
SVDYETDSKIQETIIREFSQCTILCIAHRLKTIINYNRILVLDKGELQEYDTPINLFNTDGSIF
QQMCERSNITEEDFKDVQNF SEQ ID NO: 105 *Metschnikowia bicspidata* ABC transporter polypeptide sequence
MTELQLQNRLLTPFLPKTVPPIPEENERPEYPTTLNPLSYLFFWWLHPVMRVGYKRTLEP
ADMFTLNEDIKVETLTRRFQGIFKRRLDTAQHQHVLAKIKQRSETSETSSVSFAEDVRDL
ELLKHFLTVALFLTFKWQYSLACIFLVLASVGLSTAPLLSKKLIEFVELRALGADVSIGSG
VGYALGSSFLVLVIGLLLNHTFQKSMLTGAQTNAVLVKAILDKSFRLNGQLRHDYPVSK
ITSIMSTDLARIDFALGFQPFLVSFPVAVGITIGILCDNIGAPMRANKFTDSRVNYMKE
VLSNLKMIKFYSWEAPYFDRITENRTDEMHIIFNMQMVRNTIVSVATSLTLFASMASFLV
VYATLGSTQSPAEIFSSVSLFNSLTQQVFMLPLALSTAADAAVGIQRVAGFLAAEETDTL
ALETDVRPEMVEYMDRKKLAVKISNATFKWDSYQSAEPELTSSDSGTLHGDKLSKSGK
HVPLAALGKLDVSSSSSEALEATIFDSLRNIDLEIRKGEFIAITGLIGTGKSSLLNAIAGFM
SRKDGAIDTVGSLLLCGAPWIQNTTVKENILFGSPLDEKRYQDVVYACSLESDKLILPAG
DQTEIGERGITLSGGQKARINLARAVYADKDIILMDDVLSAVDARVGKHIVNSCLMTLM
AEKTRILATHQLSLIGDADRIVFLKGDGTIEVGLLDDLQLRVAEFRELMAFNARAKDEEE |

-continued

Illustrative Sequences

DEENVPDGNAEKELIAKQLTRQSTAVDEEKVRHDYDANKHNDGRLIMDEARAVNAISF
DVVRNYIKYGSGVFKHYSIVPLLVLLTMISVFCQLFTNTWLSFWTELKFPGKSNGFYIGF
YVMFTILAFVFITIQFLLLTYMTIKASKVLHIKAVEQILRVPMSYMDTTPMGRIINRFTKD
TDTLDNEIGNQFRMVVNIFSTIVGVLILCVIYLPWFAIAIPALVAIFIVVSNFYQASAREVK
RLEAVQRSLVYNNFNETLGGMETIKAYKKETMFIDKNSTLINRMNESYYITIANQRWLA
IHLDFVATILVIVISLLCVFRVFDISASSVGLLLSYVLQIAGQLSLLVRMFTQLENEFNSVE
RLSEYAFRLPQEAPALISETTPHESWPDTGMIRFENASLAYRPGLPLVLKSLNMDVKPRE
KIGVCGRTGAGKSSIMAALYRLSELESGKIEIDGIDISQLGLHTLRSKLSIIPQDPVLFKGTI
RKNLDPFGESSEEELWTALTRAGLIESGKMALIKAQAQLSDNLHKFPHLEREVDHDGANF
SLGERQLISFARALVRGSKILILDEATSSVDYETDSKIQSTIVREFEDCTILCIAH
RLKTILHYDRILVLDKGEIKEFDTPWNLFTLKDSIFQQMCSKSNIVAEDFLERE

SEQ ID NO: 106 *Clavispora lusitaniae* ABC transporter polypeptide sequence
MDHESAAFSLRAPPLRQNRLLSPLFSRKVPPVPQDHERHTYPLYGNPILWFFFTWLWPV
MITGYKRTLEPNDLYKLNDKLKADALAARFEMFARRLAEDKRRHLEQAQDSSKILNSS
KNLLNSPDLADLADLADYVPSDTLCLWSLFETFKWQYLTACFLCALAQVGWTCNPLLS
KKLIAYVQRKALGIELDTGKGVGYALGVSLVVFCSDILFNQMYYLSSLTGAELKAIFTK
VMLDKSFRLNARSRRVYPASKITSIMSTDVSRIDLGLATAPMIIVAPVPLAISIGILIHNLK
APALLGIGIMILFLGFAGFLGSLLFKYRLATTQTDARVSYMKEVLNNLKMIKFYSWEK
PYMAMIKAVREKEMTFLLKMQVTRSIIISVAVSLSLVASFASFMLLYGTASASKRNPASI
FSSVALFNILALVFINLPLAIAGATDAYIGMRRVGQYLASDEHVEDEKRVTSETDRQLME
EKNLAITVSNANFEWEIFDIPDEEKIKEEKKKQKDKEKNDKKNKKKKLSLDESSHEAVT
KLEKPTSAATFKLRNIDLTIMKGEFVVTGLIGSGKSSLLLALEGSMKRNSGQVKTNGSL
LMCGAPWIQSSTIRENVIFNNPYNKSWYEQVIDVCCMDSDLEILPAGDQTEIGERGITLS
GGQKARLSLARAVYARSDIILLDDVLSAVDAKVGKRIVDECILGVLRKKTVVLATHQLS
LIESADKIVFLNGDGTVDVGTSESLRRSNEAFQKLLSHSTTEKYAEEESSISSQTDESIKKV
VVEAQISRLTSVSSTNEKTDLQKQNEGKLIMEEEKSVNAIDADVYVRYIFAGIPGVKGA
MIFAAVIIFSILSVFFNLFTSTWLSFWVEYKWRNRSDGFYIGFYAAFTVLALVTLAFGFLG
VIYVMNLSSRTLNIRAAERILYVPMSYMNVTPMGRIINRFTKDTDVLDNEMGDRMGMII
YPASIIGGVLILCIIYLPWFAIAVPPLIVVPFGFANFYQASGREIKRLEAVQRSLVYNNFNE
TLTGLDTIRGYDKTDVFLSKNIRLIDKMNEAYFITVANQRWLDVAVSFLATIFAIIISFLCV
FRVFKINASSVGLLLSNTLQISGIITTLVVVYTRVEQDMNSAERIIEYVDDLPQEAPYIISET
TPNSAWPQEGQIDFNHVNLAYRPGLPMVLKDFTVHIDPNEKIGICGRTGAGKSSIMVAL
YRMVELTSGNITIDGIDIRTLGLNNLRSKLSIIPQDPVLFQGTIRKNLDPFGLATDEQLWET
LRRARIIKSEDLDEVKSQMDPSKMHKFHLDRDVDVDGENFSLGEKQLIAFARALVRGSK
ILILDEATSSVDYATDKILQEAIVEEFSDCTILCIAHRLKTILNYDRVMVMDQGQVVE
FDKPINLFKKQGTFFQMCEKAGINEKEFGH SEQ ID NO: 107 *Kluyveromyces marxianus* ABC transporter polypeptide sequence
MAVSSSESTSSYSDVVHLQKETIPDTEIEILPDDLHSSSTGRRRTGSGAGSLKSASHVKEN
SVQIRNMYEIDKSKPETYLNHDDLEKVTESKIYEQKRLFRWFHSRKVPPIPETLEERPVYP
FRRANVISQLFFIWILPIVSVGYKRTLQPNDLWRMDDKMSIETLYERFDSHMKEFIEKAR
LEYRKEHPEATDQEVLKNAKLPKAALLKCLFYTFRYQYVTAFIFVLISNAASALTPLLTK
KLIAFVEKKSRFHDTKINSGVGYAIGSVLLMMINGIAFNHFFHLSALTGAEAKSLLIKTIL
HKSMKLSAYSKHKFSNGKITSLMSTDVSRLELAITFHPFLYAFPMVFVIALVLLLINIGVI
CLVGFAIFFAITFINFGAFKKILQFRLAATSITDKRVAMMREILNSIKMIKFYAWEDAYEE
NVKKVRAIESRLVKMMQLVRNTLVSLTMAFPNLASMVTFLAMYKVNKGGRSPANIFSS
LSLFQIMMIQMFFIPMSISTGIDAYVGLGRVQELLEAEEESDRYIENEEDLVLDDDTVFKV
KNASFEWENFEFEEAKELAKEKGESMSFSDRSVDTEKEDPGAEKTRFNGFHDLNFEIKE
NEFIIITGAIGTGKSSLLNAMAGFMSRTSGSMAVNGDLLLCGYPWVQNATVRDNITFGSP
FDQEKYEKVLEICSLEADLDILPAGDNTEVGERGITLSGGQKARITLARAVYKDMDIYLF
DDVLSAVDSRVCQHIVEHCMMGYLKDKTRILATHQLSLIGQASRVIFLGTDGSFDIGTVE
ELLSRNKGFHKLMQFQNSKPVDGDEHSTNDENVFSEEDEESILRKQKSLTVGKKEEDGR
IIEKEERAVNALSFKVYKEYVSSGLGKYALMMIPIFLFIVASATFCNLFSSVWLSFWTEN
KFKHRTTGFYMGLYVMFVLLGIIFMWIEFVSVGTMAVNASKWLNLKALHRLLHAPMG
FMDVTPIGRVLNRFTKDTDALDNEISESLRLFIYQTANLTGIIILCIIYMPWFAIAMPFMIF
AYVFIADHYQASGREIKRMDAIQRSFVFNNFNEVLGGIDTIKAYRSQERFLMKSDFLINK
MNEAGYLVASIQRWVSITLDLLAVVFALIIALLCVTRQFHISPGSVGVLLTYVLQLPGLL
NGLLRSQTQTENDLNSAERLVNYAYDLPMEAQYRKLETQPNESWPSEGRIKFEHVSLSY
RPELPLVLKDVSIDIKGSEKIGICGRTGAGKSTIMSALYRLTELRSGKITIDDIDISTLGLYD
LRKKLAIIPQDPVLFKGDIRKNLDPFQECTDEQLWDALVRGGAIEKSELETVKLQKKDSH
GLSGNMHKFHLDQSVEENGSNFSLGERQLLALTRALVRGSKILILDEATSSVDYETD
AKIQSRIVEEFSRCTILCIAHRLKTILNYDRILVLDQGEVVEFDKPETLFNDHSTIFYQM
CCGAGITAEDFSS SEQ ID NO: 108 *Pachysolen tannophilus* ABC transporter polypeptide sequence
MSARDIEKQDLLESLKAQKRFLSVFFPKEIPPLPSEAERNPYPASDVNIFSRIFFYWLNKL
YVKGYRRTLEPADLWYLANDYEVNHYFERFNSHYQLSLKKKSENYALINESIYQQDDV
LDESSKERSKKLTSLHTNIVVLCVFKTFAKEIVLVWLCFLFAMFSSAGAAIFSKYLILFVE
STTSSIGAGVGYAIGTSICTWLLSVGENQFFYNAQVLSYKVSSILIKLTMTKALKLDARG
RFKYPSSKISSIIGGDLSRIQDGCLYFIALLGVPLPLILFIGILIWNIGVSSLAGIGVFLLLIGC
TSSFATKLFSLRSDINIWSDKRLSYIKEILNNFRIIKYYTWENYYFKKIYDVRKKEMNYVF
TSQFIRTVMISIIISSTYLSTMISFLVLYYSKSSKRNVANIFSSISMFNILSTLIAAFPFFVSSST
DAYAGLKRFGELFSCGESDENLLLKYNDIEDDLFEDENFKMRKGSNEPAIKIENASFEW
ETFEIDDDDVDVENEKEEKKTKKNKKKCKKNNENENKNQESKISKSKDFSLIDLNLSIDR
GEFIIVTGVVASGKSSLLNAMSGFMKCIEGSIEVNDSILLCGESWVQNATIKDNILFGKEY
DKKKYKEVLYACDLTADLKNFPAGDNTEIGERGITLSGGQKARLSLARACFDSKNIILM Illustrative Sequences DDVLSAVDAKVGKHIMENCILGYLKDKTRILATHQLSLVGAADRVIFLNGDTIDVGTS
QELLETNEGFISLMQHATDNNNEDSIVEAEEVEAGKDESQDLLRIRSTKLMVTTSIQSIDD
NESKCIGKLVEVEERAVNSIQYDVYRNYVKLGSGIFGVFFLPVLVVILSLGIFASIFQTVW
LSYWTEYRFSSLTNNEYVGIYIAINIATIIFVLCINTLLVYISNNAGRLLTVKGVERLLHAP
TSFMDSTPMGRILNRFTKDTNCVDIELSEYLRLFVTPVGLVVGTVILSIVYIPWVAVAVPF
FAFIFFCITNYYQASSREIKRLEAVQTSFVFSHFNETLNGMNTVKAYKAEKRFKSKNDFY
INQRNEALFLTTANNSWIKISLGTFSSLFILFVSLLCVSGVFSLGAGATGVLLSNLLNIADQ
LTTALVQFTNLENSMNSVERLYHYAFKLPQEAAYEIRETQPSPQWLTVNSNIEFRNVFM
QYSKNSPFVLNRLNFEIGTGEKVGICGRTGAGKSSIMTALYRLCEITEGEIIDQVDISKIG
LETLRSHLAIIPQDPIMFSSTLRKNLDPFDKFSDDKLYDVLKIVTLVDDIEKVKRQDGYH
GETLHKYNLNQSVSEAGSNYSLGERQLVSLARAILHDSKILIMDEATSSVDYDTDEKVQ
RIIKQQFSHCTILCIAHRLKTIIDYDRILVLEKGEVIEFDTPYNLFCTEDGVFKEMCEKSRIV
ESDFNKVN SEQ ID NO: 109 Kerivoula Africana ABC transporter polypeptide sequence
MGPNINHTVDNIPSNSSSKMDEDDEYYKTSSNTSSLDSSSDEFSYLPTGEYKVQKNKPKT
YLNIDDIERVTDSEIFPQKRLFSFLHSKKIKEVPTNDDERPIYPFFHANIISRTFVWWVMPI
LKVGYKRTIQPNDLFRMDPYFSIEKMSSDFDKNMDYYFQKTYNKYRKEHPNATEDEVY
EHAKLPKLTVFKALFWTFKRQYITSCICAILANCASAFNPMITKRLLEFVERKAVLKHMK
VNDGIGYAIGACLMMLFNGILFNHFFHNSQICGVQAKSILTAAALNKMFRASKYARHKF
PSGKVTSFVTTDLARIEFALSFQPFLIGFPPLLIICIVLLIVNLGAIALVGIGLFFVVAVFVM
VIFKKIVDLRMSANTFTDARVTKMREILNNMKMVKYYAWEDAYEKNIQEIRSEEISRVR
KMQYIRNGVIALAISLPNIASLATFLSMYKVNNMGRTPANVFSSLSLFQVLALQMFFMPI
ALATGIDMMIGLGRLQDLLQAPEEHSRLIEDRKPDPEVEKSNIALKLDNCSFEWDDFEEL
DLLEEAEKKKKEKKKNKKKKDDPKAKTKKSLKKEKENNEIEKAFSKFSNLDFEIRKGEF
IMITGPIGTGKSSLLNAFAGFMNKTEGRIQVNGDLLFCGYPWIQNATVKDNILFGSPFIKE
KYENVLRVCSLDADLKVLPAGDKTEIGERGINLSGGQKARINLARAVYKTKDIFLFDDV
LSAVDSRVGKHIMDECLLDLLEGKTRILATHQLSLIEKADRVILGTDGSFDIGTVDELK
QRNQTLTNLLDYSTTERENENRDESPVADEENDELLIQEELKIQLLQTTTRNEDAEDVSG
GDGHLIEKEERAVNSIGWEIYKQYIIAGVGKWGFVVIPAYILFIVITSFCQVFSSVWLSFW
TEDKFPTRSPSFYMGLYSFFVFGGFVFMCVQFTTLCSIGVLASKWLNLNAVHRVLHAPM
SYLDTTPLGRILNRFKDTDSLDNELTESVRLMLFQVGNIVAVIVMCIVYLPWFAIAVPF
LFFMFVLIADHYQSTSREIKRLDAIQRSFVYNNLNEVLGGMDTIKSYKGQKRFQAKSDY
LINKMNEAGYLLVSVQRWVSIFLDMVAIIFALIIALLSVTGVFSLSASSVGVLLTYVLQLP
GLLNSVLRALTQTENDMNSAERLVNYATKLPLEAAYKKPELSPPESWPSKGEIRFLDVD
FAYRSGLPVVLKGLNLDIKSGEKIGICGRTGAGKSTIMSALYRLNELTSGKILIDDVDIST
LGLYDLRRKLSIIPQDPVLFKGTIRKNLDPFSNYDDSLLWDALIRSGAIEKESVEKVKSEM
VNEEGTHTDMHKFHLDQLVEEEGSNFSLGERQVLALTRALVRQSKILILDEATSSVDYE
TDGKIQKRIVEEFDNCTILCIAHRLKTILQYDRILVLEKGVIAEFDQPFKLFSDKDSIFRSM
CERSNITESDFKIQK SEQ ID NO: 110 Saccharomyces cerevisiae ABC transporter polypeptide sequence
MSEACKLEAIDAVDASSSAGSVDSQYYNELQQKIQVKKGWPLLKLLVGKEPQPITPSDK
KYPYYTANLWSLLTFAWAFEIIKKGYLRRVEDEDMYELPDNIKIKAMTELFEDNFRKRR
EAFSLKYGDDVPFTKWVVIRALNDTFFKEFWLIAGTAKVVMDLAQVLSPLLVRQLVRYI
QLKSSHDPGVGNAIGYSIGISAMIMLTSVSLSHFFHSSMVVGGCVKAVLTNVIYKKAFN
VSSKVRFQYPNGKINSLVMADLARIDLAVGVFHFIWAFPLSLSIATIVLCCYLGAVALIGI
ATVVLFLVSIFWFNAKLKQLRIKANVFIDKRVRAINEIINNMKMIKLYSWEIPYKERLAE
YRGVEKEFIFKVQMLKSIMNSGINSITGIATMLTFIALFYLSGSHFQSYNVFSAVTLFNMI
RMPINLLPMATSFATDALIAMDRVTGFLQAEDDELTVSRLPVEGSTNAIEIHDATYQWDI
EPRDDLITSVTSETLEKDLSFPGLRNINLTIKRGDLIIITGSIGTGKSSLLNAIEGTMRQESG
DAKVYGSLTFCSYPWVQNATIKENILFGMPYNREKYHSVVSACGLDVDFKALPGGDQV
EVGERGITLSGGQKARINLARAVYADRDIILLDDVLSAVDATVGKHIMKECICGLLKDK
TRLLATHQLSLIDAADRIIILDGTGSLQIGTQSELLQTSPTFSNLMNFSRQPEEQEREKEED
VMIDDEEEKELQRVQTQISTAKKEKAESREEQRSMESISIKVYLNYLALGSRLFGRFIIPIF
FLTIAVSGFLQLFFSVWLSFWLSDRFGYSSQLYTGLYVLLVMLSTLAFVCLFTLMASLNN
TAGLRLFNMSSSKLLKTPMWFMDITPIGRILNRFTKDVDVLDTDLIEQLRLFVTSSSTVC
CTIILCACYIPWFLIAVPVALFIYVHLFIFYKSSALDIKRLESVNRSLVFSLFNESLNGMKVI
KSYSSVERFQHRFESLINKMNSAYFLTFANQRWLSIRLDCIGSLLTLFICIMCVCDVFHLS
GSSSGLLVSYIIQVSSLMSLLLRSMTMVENDMNSVERLFEYAMDLPEEGPFEIEETKPRES
WPEKGAIAFNNVSLSYRENLPLVLKNVSFDVKPGEKIGVCGRTGAGKSTIMNALFRVSP
VREGFITIDGVDTSTIGLSDLRSKLSIIPQDPVLFHGTIRENLDPFGSSSDAELWDALRKSW
LVEDGARGTGSYKIGETNITTLHKFHLDQLVEDDGANFSLGERQLLALARALVRDSKVL
ILDEATSSVDYETDVKIQSTIANDFAHCTILCIAHRLRTILNYDRILVLDKGQ
VVEFDTPLNLFKLGGIFSGMCQRSGITEREFP SEQ ID NO: 111 Saccharomyces cerevisiae ABC transporter polypeptide sequence
MGDHTGDDNSSVESVGRYQGFDSQVEGQIQDLVRTLTQKSEAAFQEGQNESDGESVLS
RALSRVSTIAPGVNPMGEDLEELDPRLNPDNPDFSSRYWIKNIRAFMDKDEAHYQNYSF
GIAYKNLRASGEATDADYQTTTLNAPYKFAKMYAKQLFTTKAQKAKSQFDILKPMDGL
IKPGEVVVVLGRPSGSGCTTLLKSIASNTHGFEIGEESKISYEGLSPNEIKKHFRGDVVYNA
ESDIHFPHLTVWQTLYTAAKFRTPQNRIPGVSREDFATAMTNVYMATYGLLHTKNTKV
GSELVRGVSGGERKRVSIAEVSLAGAKLQCWDNATRGLDAATALEFIRALRTSADVLD
TTAIIAIYQCSQDAYDLFDKVSVLYDGYQIFPGRADEAKEYFIKMGWECPQRQTTADFL
TSVTSPRERIPRKGYEDKVPRTAKEFEAYWKASQEYSFLVKEIDATISQNEQTNQSSEYY
ASKHARQSNHMRKSSPYTVSFFMQTRYLLTREFQRIRNDIGFHAFSVLSNSLMALVLSSI
FYNLPSTTSSFYYRGASMFFAVLFNGFQSFLEIMSLFEARPIVEKHKGYGLYHPAADALA

| Illustrative Sequences |
|---|
| SVTSQLPFKLFTSLFFNLIYYFMVNFRREPGNFFFYLFVNILATLTMSHFFRLVGSMSSTL
PQALVPAHVIMLAMILFTGFTIPINYMLGWCRWINYLDPMAYAFESLMVNEFHNRIFEC
SSYIPGNPADNPSWPSDSWVCNAVGASAGETYVNGTLYLKTSFRYSHGHKWRNVGILI
VFMIGLLAAYTLFAEFNESAKQKGEILLFQSSTLRQLKKDKANNDIEAGKERDITEAPEE
EDVNVDAIQAGKDIFHWRDVHYTVKIKSEYREILSGVDGWVKPGTLTALMGASGAGKT
TLLDVLASRVTMGVVTGSMFVNGHLRDSSFQRSTGYVQQQDLHLETATVREALRFSAY
LRQPSSVPKQEKNEYVEEVIKILDMQKYADAVVGVAGEGLNVEQRKRLSIGVELAAKP
KLLLFFDEPTSGLDSQTAWSICQLMRKLANHGQAILCTIHQPSAILMQEFDRLLFLARGG
RTIYFGDLGKNCQTLIDYFESHGSPKCPPEANPAEWMLHVIGAAPGSHANQDYHQVWL
ESDERKEVLKELDYMERELVKLPYDSTVGHREFATSIPYQFVVVLKRVLQLYWRTPSFT
WAKLFLSISSCIFIGFVFFDADLTIQGLQNQMFALFMFLTIFNPMIQQQLPMFVSQRDLYE
VRERPSKTFSWKAFMAAQIVADIPWNIVLGTIAYFVFYYPAGFYHNAEPTHQVNQRGA
YAWFFSCLFFVFMGTFGSLCVAPLQLADSAGNVAMLCFTLCLTFCGVLVGPDALPGFWI
FMYRVSPFTYYIDGFLSNALGNAQVTCSQAELRVLNPPDSNMTCSEYLGDYIEAAGTGY
LVDGSATSECALCPMSSTNAFLRSVSCSYSRKWRNVGIFCAYIVINIVGALFFYWLARVP
KKRNRVKDERPEATTSVGEGKEV ESNLEKASSD SEQ ID NO: 112 *Saccharomyces cerevisiae* ABC transporter polypeptide sequence
MFNNRAVKDIDNFITRDVDRFASSLAALFSNIGKPMMDLVFFAVYLRDNLGTAGITGIFV
NYFTTAYILKCFTPPFGKLSKEKSSLEGEYYNDHLNLINNGEEIAFYNGTMLEKIKINKVY
NNMMDHIFKINRIKVRYTFLEDYLLKYTWSALGYLYISIPIFLASLQDDVKRSTEDRNMR
QFIVNKRLMLSMADAGSRLMYSLKDISKLTGYTDRVFTLLTVLHQVHAAEFNYGDESD
VNTLRGTVQYHYNGLRFEKINVIIPSKNGHDGIKLIKELDFSLKSNQSILILGMNGCGKTS
IERIIAGLWPLYDGLLSKPSEDDVIYLPQRPYFSTGTLRDQIIYPLSYADMLDRGVTDLDL
VQILREVKLEYLLDRECGLSYLDSVQEWKDVLSGGEKQRVQFARILFKNPKFVILDEAT
NAISSDIEAYLFDLLKQKKFAFITLSHRPLLIKYHDYLLEIQENGDWIFETMGSDQAITSIE
KEIKQIEEKLKDVAKLEGRKHTLELLLDGHEVNDTIVTASKMLESSVEVIQEIETEPATIS
NATSKPSAKPLPKPLAKPGANLGRASPMKASHPSKPNATTTSGGSPRPSKPSPKPSLSSLK
RSPSIISNSSSKSSSSTSSSKPPSKPGRGLKNTLKKAVSKKPPTSK SEQ ID NO: 113 *Saccharomyces cerevisiae* ABC transporter polypeptide sequence
MDNLILPHKLLSKRQLKWLAQLNIRWTSKPVLLFLTAVLSSVAGISAYNIAKLIQNIRNY
LLKRSKNRPLQRGNRIAKQIEVPYKNSTISVDIPYPNYDRISVDNLVFKQYIKEEMLLKDS
PGATSFWKAINSRFLNKLFIIWKLILIPKWLDKNSYLLVAQLSLLILRTYLTLLVTKLDGSI
VKNLIGLQGKKFIRDIIYWFLLAVPASYTNSSIRYVTKRLSLSFRTNLLRYCHDLYMDNR
LVFYKMQFNTNEMLPKEYQLDSKYIDQYLTDDIKQFTSTLASLFTNTGKPFMDLIFFAIY
LRDNLGTAGIVGIFTNYFITCWFLRLKAPKFSKMLKKKANLEGIYYNYNLNLIYNAEEIS
FFKGIPLENRKIKSIFGDLQKQIFKEMVQRFHYGFWEDYILKYTWSCLGYLYSAIPILLAP
TSKRTSNSSKNMKNFIVNKRLMLSMADAGSRLMYSIKDVSKLSGYTDRIFTLLLNLHQV
HDSGFQYGLDLTNGQQTSLARLPSLRILSSFTNLNHLSSQNMKSLGFINGIIQTNYDGLRL
ENIPIIVPSPKGANGPKLIESLSFTIKKGNNLLIIGKNGCGKTAFMRCLAGLWPIYEGLLSK
PLDSNIMYVPQRPYFLSAGTLRDQIIYPLSSETSKVDDELLIGLLKDVGLEYLFERFNSDL
NFRPSIKNDNVTASNGTERDSGNISKNSWFSLLSGGERQKMIIARVLFHNKTYVVLDEPT
NAISYDMEDYLFKLLKKRGLTIITISHRSSLEKYHDYCLELVSDLNEKVVELDDEKTSEM
PITTHKWKFKNLREDSDDSDSLDDEISDYRHKIRDLYKNHRNTDSEGSSVEDRNELAKE
EIKILKNELSKLEELEKRKLEVLNYLDNE SEQ ID NO: 114 *Saccharomyces cerevisiae* ABC transporter polypeptide sequence
MRLFKRKKDPEKEHLDEKDAQFKNPDDQLNEKFDQLDPATREVLEGQLKGVSFKASLA
DLYGLLRGWEYLIAFIAYVCSIIAGAALPLMTLVVGDMAQQFTNYFTGVLGRSEFEDKI
RDNSLYFVYLGIGLTVFQYLATFLHIVISEIIASRVRQKFVWSILHQNVAFLDSMGSGEIT
ESITSDTRLIQEGVSEKIGMTVECLATVVSALVVAFAKYWKLALVLLSVMVGLIMSATP
TTLMLIKMYMKSLESYGKASSIAEETFSAIRTATAFGAHEFQLSRYNIFILESRYGFKKA
LWLSLMIGSVWFIVFNTYALAFWQGSRFMVSDNSGIGKILTACMAMLFGAMTIGNVTT
HMKDVSVGIGAASKLLAVINREPYLDSSSEDGSKLERVDGSISFRNVTTRYPSRPDITVLS
DFTLDVKPGNTVALVGESGSGKSTVIGLLERFYEYLDGDILLDGVSVKDLNIKWLRQQI
ALVQQEPVLFAASIYENICYGLVGTKYEDAPEEVKRDLVEKACKDANAWEFITQMSHG
LDTEVGERGLSLSGGQKQRIAIARAVISQPKILLLDEATSALDTKSEGIVQDALNRLSESR
TTLVIAHRLSTIQNADLIVMSNGRIIERGTHQELIKLRGRYYQLVQVQNINTKINSTQVT
KSIAASTISDSENDKPNDSESLIYEPSPEIASDLPPQKKPSVGQLFLMLLKISKGEYHLIIPA
MFCALIAGMGFPGLSLLMGHIVEAFQVSGPDEYPHMRSQINKLTGYLFMIGVIEFINYIFL
ISSLVMASEYLIYKMRYRCFKQYLRQDMAFYDQPQNKVGSLVTMLAKDPQEIEGLSGG
TAAQITVSVIIVVVGIIISLITNWRLGLVCTSTVPLLLGCGFFRVYLIIMFEERSLKSYQGSA
SYACEQVSALRTVISLTREKGIYDKYSKSIKAQVRRSTQSVAKTAIMHGLIQGMVPWIFA
LGFWYGSKLMIEGRCTNREFFTVLIAILFGAQSAGQIFSYAPGMGKAKQAAANVKKVLD
TFPNVIDIESEEGAIVDPSEVKGGIEFRNVTFRYPTRMEVVPLQDLNLTIKPGQYIGLVG
ASGCGKSTTVGLIERFYDPLSGEVLLDGVDIRNLHLRTYRQALALVQQEPVLFGGSIRDN
ILLGSIDEVSDDEVIEACREANIYDFVSSLPEGLDTLCGNRGAMLSGGQKQRIAIARALIR
NPRVLLLDEATSALDSESEKAVQEAIDRASKGRTTITIAHRLSTIQNCDVIHVFEGGKI
IESGKHDELLALGGKYYDLVQLQGLESQN SEQ ID NO: 115 *Saccharomyces cerevisiae* ABC transporter polypeptide sequence
MTAEESSQSSVDIRDGEKSGGRIPSTPDVSNYSPGIDGESEHRPYFGLENDIQEQQHIQK
LARTLTNLSMASRNSSGAHIPAGSHKAEDHDSIAEAAKSITNDTLQRSLSRASHTLEGGP
VDVPFDENARELDPRLDPDSPEFDSKFWVQTMHHLFNSDPEYYKPMRLGVCLKDLRVS
GVSNDADYQITVANVPLKVYEKVKSWVTKRDESRYFDILKPMDALFEPGRVCVVLGRP
GAGCSTLLKTVSARTYGLTVRPESVISYDGIDQKTIVNHYRGDVIYSPEIDFHKFANLTVG |

-continued

Illustrative Sequences

YTLEFAARCRCPSSRPAGISREQYYKHYAAVTMATYGLSHTYNTKVGDDYVRGVSGGE
RKRVSIAEVSLAGAKVQCWDNATRGLDSATALEFVRALKTNASVTGTTPLIAIYQCSQD
AYDLFDDVLVLYEGYEIFFGTADSAKDYFVDMGWECPPRQTTADFLTSITSPSERKPRPG
FEKTVPRTAEEFYDRWSSPEHAELRNRIDAYLNKHSNGQAAQTMHDHHTARQSKHSK
PTSPFLISFGMQVKAVMDRNWQKIKGDPSVYCFNIISNCIMALIISSMFYNQKANTGSFY
YRTSAMFTGLLFNSFSSLLEILALFEARNIVEKHKTYAFYRPSADALASIMTEMPSKFLIA
VGFNLIYYFMINFRRSVGHFFFYFLIALTSMFAMSHLFRTVGSACVSLQQAMIPASILLLI
LSIYVGFIIPKGNILGWSKWLYYLNPIARSMEAMVANEFAGREFECSQFVPSGGDYDKLP
LQNKICSVVGSEPGKSMVSGTKYMRLSFDYRNGHRWRNWGIVVCYAAFFLGTYLLLIE
YNKGEMQKGEMTIFPRSTLKKLKKKQGLKNDIESNDSLLKDETVADSHDEKSHSSSGD
GAVEGIGSDQVVFWRNICYDVQIKSETRRILSNIDGWVKPGTLTALMGSSGAGKTTLLD
TLANRVTTGVITGDVFVNGRPTDESFQRSTGYCQQQDLHGRTQTVREALTFSAYLRQPY
KVPKKEKDEYVEKIIDLLEMRSYADALVGVTGEGLNVEQRKRLTIGVELVAKPKLLLFL
DEPTSGLDSQTAWSVCQLMRKLASHGQAILCTIHQPSAILMQEFDRLLLLQKGGRTVYF
GELGKGCSKMIEYFESKGSEKFPPDCNPAEFMLHVIGAAPGSHVTTDYHQVWLESQEYQ
DVQKELGELMKRANQPIEDNDEDLHKEFATPFWYQLMIMTKRVLEQHWRSPGYIVAKL
WTVAFSAIFIGFSFFKANNTLQGLQNQMFSLFMLMMIFNPLVQQMLPQYTDQRELFEVK
ERPSKTCDWKTFVLAQLLAELPWCLVTGSLAFFCFYYPVGLYRNCPDHYQLHERGALF
WLICVSFTLFTTTFGQVCIAGLERRENAALVANTCFMMCISFCGVLVSKEHLPGFWKFM
YYISPFTYLIAAMMATGISNTEVICAKKEYLHFPPPNGQTCGKYMKAYMEKAGGYLLDE
NSTTECTFCTMSQTNAYLKTLDIHYSQKWRNWVIFTCYSIFNVFLFVLLYWLFRVPRDH
VFFKKLAGKKEEWVASRKKKKDA KDAANQV

SEQ ID NO: 116 Calathea utilis ABC transporter polypeptide sequence
MDGSHFPMTSTTGEPVLSGKKGKRRKVIKSCAFCRKRKLKCSQARPMCQQCVIRKLPQ
CVYTEEFNYPLSNTELFEQVPNVALVQKIENLQTLLKENDNNNAKPVYCRSSENPLRSL
RTSVLGDNGSRYVFGPTSWKTLSLFEQNKFQTEFQNLWKVLKPLPECTKSQLNENDVV
ADLPSFPQMESCIKSFFAGPLFDILHIFNQDDILSLLDRLFIRDTTDKNLVILLDLQGNAKD
KYNLGIVLQILCLGYYNQDIPSSVSRFLHSLSAASLSSSSSNFVEKLQFFLLSYISVMINCT
DGVWDATQGVDLINELCQGCISLGLNDIDKWYLNESEETKQNLRCIWFWALFLDVSTS
YDIGNPPSISDDLFDLSIFTAQNFQSPSIDFRRVKLMHDFLDVSRFTTREIHKREMNEKLTT
FSLRLIEFIQSNFSPIEHYTNSVYYSDIDPFDILILSRSLSIVASIYNIEMIIAQQSRIIDKNRM
VQFLLISISVCVNTMVPHFKEPINDQENVLTEGLKLSIILINPLLIRIVSQVYSLAFNRLIFRE
KGFLFLIDLDTGKKIQFIKYEEENFDELLTGFDVRTDKFLSFSGTIIRFYEIVDSIFAVNERN
KRLLKAVSNFYQLTSTLAFERVSRVLFDKASQARIETEKIWLKKGINME
HFSDLMIEDFINDVWKTFKEISKDLWSIDKKKFYKQYHFDL SEQ ID NO: 117 Calathea utilis ABC transporter polypeptide sequence
MSDQESVVSFNSQNTSMVDVEGQQPQQYVPSKTNSRANQLKLTKTETVKSLQDLGVTS
AAPVPDINAPQTAKNNIFPEEYTMETPSGLVPVATLQSMGRTASALSRTRTKQLNRTAT
NSSSTGKEEMEEEETEEREDQSGENELDPEIEFVTFVTGDPENPHNWPSWVRWSYTVLL
SILVICVAYGSACTSGGLGTVEKKYHVGMEAAILSCSLMVIGFSLGPLIWSPVSDLYGRR
VAYFVSMGLYVIFNIPCALAPNLGCLLACRFLCGVWSSSGLCLVGGSIADMFPSETRGK
AIAFFAFAPYVGPLVNGFISVSTGRMDLIFWVNMAFAGVMWIISSAIPETYAPVIL
KRKAARLRKETGNPKIMTEQEAQGVSMSEMMRACLLRPLYFAVTEPVLVATCFYVCLI
YSLLYAFFFAFPVIFGELYGYKDNLVGLMFIPIVIGALWALATTFYCENKYLQIVKQRKP
TPEDRLLGAKIGAPPAAIALWILGATAYKHIIWVGPASAGLAFGFGMVLIYYSLNNYIID
CYVQYASSALATKVFLRSAGGAAFPLFTIQMYHKLNLHWGSWLLAFISTAMIALPFAFS
YWGKGLRH KLSKKDYSIDSVEM SEQ ID NO: 118 Calathea utilis ABC transporter polypeptide sequence
MTLGNRRHGRNNEGSSNMNMNRNDLDDVSHYEMKEIQPKEKQIGSIEPENEVEYFEKT
VEKTIENMEYEGEHHASYLRRFIDSFRRAEGSHANSPDSSNSNGTTPISTKDSSSQLDNEL
NRKSSYITVDGIKQSPQEQEQKQENLKKSIKPRHTVMMSLGTGITGLLVGNSKVLNNA
GPGGLIIGYAIMGSCVYCIIQACGELAVIYSDLIGGFNTYPLFLVDPALGFSVAWLFCLQW
LCVCPLELVTASMTIKYWTTSVNPDVFVVIFYVLIVVINVFGAKGYAEADFFFNCCKILM
IVGFFILAIIIDCGGAGTDGYIGSKYWRDPGAFRGDTPIQRFKGVVATFVTAAFAFGMSE
QLAMTASEQSNPRKAIPSAAKKMIYRILFVFLASLTLVGFLVPYTSDQLLGAAGSATKAS
PYVIAVSSHGVRVVPHFINAVILLSVLSVANGAFYTSSRILMSLAKQGNAPKCFDYIDRE
GRPAAAMLVSALFGVIAFCASSKKEEDVFTWLLAISGLSQLFTWITICLSHIRFRRAMKV
QGRSLGEVGYKSQVGVWGSAYAVLMMVLALIAQFWVAIAPIGGGGKLSAQSFFENYL
AMPIWIALYIFYKVWKKDWSLFIPADKVDLVSHRNIFDEELLKQEDEEYKERLRNGPYW
KRVLD FWC SEQ ID NO: 119 Pichia pastoris ABC transporter polypeptide sequence
MGIHIPYLTSKTSQSNVGDAVGNADSVEFNSEHDSPSKRGKITLESHEIQRAPASDDEDRI
QIKPVNDEDDTSVMITFNQSLSPFIITLTFVASISGFMFGYDTGYISSALISIGTDLDHKVLT
YGEKEIVTAATSLGALITSIFAGTAADIFGKRCLMGSNLMFVIGAILQVSAHTFWQMAV
GRLIMGFGVGIGSLIAPLFISEIAPKMIRGRLTVINSLWLTGGQLVAYGCGAGLNYVNNG
WRILVGLSLIPTAVQFTCLCFLPDTPRYYVMKGDLARATEVLKRSYTDTSEEIIERKVEEL
VTLNQSIPGKNVPEKVWNTIKELHTVPSNLRALIIGCGLQAIQQFTGWNSLMYFSGTIFET
VGFKNSSAVSIIVSGTNFIFTLVAFFSIDKIGRRTILLIGLPGMTMALVVCSIAFHPLGIKFD
GAVAVVVSSGFSSWGIVIIVFIIVFAAFYALGIGTVPWQQSELFPQNVRGIGTSYATATN
WAGSLVIASTFLTMLQNITPAGTFAFFAGLSCLSTIFCYFCYPELSGLELEEVQTILKDGF
NIKASKALAKKRKQQVARVHELKYEPTQEIIEDI -continued Illustrative Sequences SEQ ID NO: 120 *Pichia pastoris* ABC transporter polypeptide sequence
MAIWEQLEVSKAHVAYACVGVFSSIFSLVSLYVKEKLYIGESTVAGIFGLIVGPVCLNWF
NPLKWGNSDSITLEITRIVLCLQIFAVAVELPRKYMLKHWVSVTMLLLPVMTAGWLIIGL
FVWILIPGLNFSASLLISACITATDPILAQSVVSGKFAQRVPGHLRNLLSAESGCNDGMAF
PFLFLSMNLILHPGNGREIVKDWICVTILYECLFGCLLGCFIGYVGRITIRFAEKKNIIDRES
FLAFYVVLAFMCAGFGSILGVDDLLVSFAAGATFAWDGWFSQKTQESNVSTVIDLLLN
YAYFIYFGAIIPWSQFNNGEIGTNVWRLIILSIVVIFLRRIPAVMILRPLIPDIKSWREALFV
GHFGPIGVGAIFAAILARGELESTFSDEPTPLNVVPSKEESKHWQLIACIWPITCFFIVTSII
VHGSSVAIITLGRHLNTITLTKTFTTHTTNGDNGKSSWMQRLPSLDKAGRSFSLHRMDT
QMTLSGDEGEAEEGGGRKGLAGGEDEEGLNNDQIGSVATSGIPARPAGGMPRRRKLSR
KEKRLNRRQKLRNKGREIFSSRSKNEMYDDDELNDLGRERLQKEKEARAATFALSTAV
NTQRNEEIGMGGDEEEDEYTPEKEYSDNYNNTPSFESSERSSSLRGRTYVPRNRYDGEET
ESEIESEDEMENESERSMASSEERRIRKMKEEEMKPGTAYLDGNRMIIENKQGEILNQVD
IEDRNEARDDEVSVDSTAHSSLTTTMTNLSSSSGGRLKRILTPTSLGKIHSLVDKGKDKN
KNSKYHAFKIDNLLIIENEDGDVIKRYKINPHKSDDDKSKNRPRNDSVVSRALTAVGLKS
KANSGVPPPVDEEKAIEGPSRKGPGMLKKRTLTPAPPRGVQDSLDLEDEPSSEEDLGDSY
NMDDSEDYDDNAYESETEFERQRRLNALGEMTAPADQDDEELPPLPVEAQTGNDGPG
TAEGKKKQKSAAVKSALSKTLGLNK SEQ ID NO: 121 *Kluyveromyces marxianus* ABC transporter polypeptide sequence
MRGLTPKNGVHIETGPDTESSADSSNFSTGFSGKIRKPRSKVSKACDNCRKRKIKCNGKF
PCASCEIYSCECTFSTRQGGARIKNLHKTSLEGTTVQVKEETDSSSTSFSNPQRCTDGPCA
VEQPTKFFENFKLGGRSSGDNSGSDGKNDDDVNRNGFYEDDSESQATLTSLQTTLKNLK
EMAHLGTHVTSAIESIELQISDLLKRWEPKVRTKELATTKFYPNKSIETQLMKNKYCDV
VHLTRYAAWSNNKKDQDTSSQPLIDEIFGLYSPFQFLSLQGIGKCFQNYRSKSKCEIFPRT
AKETIYIMLRFFDVCFHHINQGCVSIANPLENYLQKMNLLPSTPSSISSAGSPNTAHTKSH
VALVINHLPQPFVRNITGISNSELLSEMNNDISMFGILLKMLDMHKNSYKNFLMEITSNPS
VAKNTQSIDVLQEFIHYCQAGEALIALCYSYYNSTLYNYVDFTCDITHLEQLLYFLDLLF
WLSEIYGFEKVLNVAVHFVSRVGLSRWEFYVGLDENFAERRRNLWWKAFYFEKTLAS
KLGYPSNIDDSKINCLLPKNFRDVGFLDNRDFIENVHLVRRSEAFDNMCISDLKYYGELA
VLQIVSHFSSSVLFNEKFTSIRNTSKPSVVREKLLFEVLEIFNETEMKYDAIKEQTGKLFDI
AFSKDSTELKVSREDKIMASKFVLFYEHHFCRMVNESDNIVARLCVHRRPSILIENLKIYL
HKIYKSWTDMNKILLDFDNDYSVYRSFAHYSISCIILVSQAFSVAEFIKVNDVVNMIRVF
KRFLDIKIFSENETNEHVFNSQSFKDYTRAFSFLTIVARIMLLAYGESSSTNLDVISKYIDE
NAPDLKGIIELVLDTNSCAYRFLLEPVQKSGFHLTVSQMLKNRKFQEPLMSNEDNKQMK
HNSGKNLNPDLPSLKTGISCLLNGIESPQLPFNGRSAPSPVRNNSLPEFAQLPSFRSLSVSD
MINPDYAQPTNGQNNTQVQSNKPINAQQQIPTSVQVPFMNTNEINNNNNNNNNNK
NNINNINNNNSNNFSATSFNLGTLDEFVNNGDLEDLYSILWSDVYPDS SEQ ID NO: 122 *Saccharomyces cerevisiae* ABC transporter polypeptide sequence
MEDKDITSVNEKEVNENTNSRIIKYDAERRATRTETSKKDKWKNIVTIIASGFALISDGY
VNGSMSMLNKVFVMEYGKKNYSSKVSTRVSNAALVGIIFGQFFMGIAADYYSRKSCIL
VATAILVIGSALCAASHGTTVPGMFWMLTVMRGLVGIGVGAEYPTSTLSANESANEYTT
TKRGGILVMVTNLPLAFGGPFATIIFLIVYKICSGTKHLEAIWRTVPAIGCFWPLSVFYFR
WKTATTEVYEKGRIKRNIPYFLALKFYWKRLLGTCGTWFMYDFVTFPNGIFSSTIISSVIK
DQNDLVKVAEWNLLLGVLAVLGVPIGAYLSDRIGRKYTLMFGFSGYIIFGLIIGCAYDRL
KKITPLFIIFYAFMNMLGNAGPGDMLGVISSEASATAVRGVFYGLSAVTGKIGSVVGVEC
FQPIRDNLGARWTFIIAAICGLIGIIITYFFVPHSLESDLMKQDVEFHNYLVSNGWTGKMG
FDETDEESMVRTIEVEENGTNCSKKNAEIISVRQVDQS SEQ ID NO: 123 *Saccharomyces cerevisiae* ABC transporter polypeptide sequence
MSEGRTFLSQLNVFNKENYQFSSSTTKKEVSNSTVDADNGASDFEAGQQFATELDQGE
KQLGILSCIGLICNRMLGTGVFAVSSTIYTLCGSVGLALIMWAVGAIIAISGLYVYMEFGT
AIPKNGGEKNYLEAIFRKPKFFITCMYAAYIFFLGWAAGNSINTAIMFLTAADTEVTKWN
QRGIGVAVVFFAFLINSLNVKIGLYLQNILGIFKIGIVLFISITGWVALGGGLKDGYQSHNF
RNAFEGTETATAYGIVNALYSVIWSFVGYSNVNYALGEVKNPVRTLKIAGPTSMVFLAII
YIFVNIAYFAVVPKDKLISSKLILAADFFDIVFGGQAKRAAAALVGLSALGNVLSVIFSQG
RIIQQLGREGVLPFSNFFASSKPFNSPMVGLFQHFIVCTVTILAPPPGDAYLLVQNLISYPM
NIINFAISAGLLWIYWQRRQGKIEWNPPIKAGVFVTGFFTLSNLYLIIAPYVPPSNGESVYS
SMPYWIHCVIAWGIFFFGGVYYVVWAQLLPRWGHYKLVSKDVLGEDGFWRVKIA
KVYDDTIGDVDTQEDGVIETNIIEHYKSEQEKSL SEQ ID NO: 124 *Saccharomyces cerevisiae* ABC transporter polypeptide sequence
MTDRKTNLPEEPIFEEAEDDGCPSIENSSHLSVPTVEENKDFSEYNGEEAEEVVVPEKPAS
AYATVSIMCLCMAFGGFMSGWDTGTISGFVNQTDFLRRFGNYSHSKNTYYLSNVRTGLI
VSIFNVGSAIGCLFLSKLGDIYGRCMGLIIVIVVYMVGIVIQIASIDKWYQYFIGRIIAGIGA
GSISVLAPMLISETAPKHIRGTLLACWQLMVTFAIFLGYCTNYGTKTYSNSVQWRVPLG
LCFAWAIIMIGGMTFVPESPRFLVQVGKIEQAKASFAKSNKLSVDDPAVVAEIDLLVAG
VEAEEAMGTASWKELFSRKTKVFQRLTMTVMINSLQQLTGDNYFFYYGTTIPKSVGMN
DSFETSIVLGIVNFASCFFSLYSVDKLGRRRCLLLGAATMTACMVIYASVGVTRLYPNGK
SEPSSKGAGNCTIVFTCFYIFCFSCTWGPVCYVIISETFPLRVRSKCMSVATAANLLWGFL
IGFFTPITSAINFYYGYVFMGCLAFSYFYVFFFVPETKGLTLEEVDEMWMDGVLPWKSE
SWVPASRRDGDYDNEKLQHDEKPFYKRMF -continued Illustrative Sequences SEQ ID NO: 125 *Saccharomyces cerevisiae* ABC transporter polypeptide sequence
MSQDAAIAEQTPVEHLSAVDSASHSVLSTPSNKAERDEIKAYGEGEEHEPVVEIPKRPAS
AYVTVSIMCIMIAFGGFVFGWDTGTISGFINQTDFIRRFGMKHKDGTNYLSKVRTGLIVSI
FNIGCAIGGIILSKLGDMYGRKVGLIVVVVIYIIGIIIQIASINKWYQYFIGRIISGLGVGGIA
VLSPMLISEVSPKHLRGTLVSCYQLMITAGIFLGYCTNFGTKNYSNSVQWRVPLGLCFA
WALFMIGGMTFVPESPRYLAEVGKIEEAKRSIAVSNKVAVDDPSVLAEVEAVLAGVEAE
KLAGNASWGELFSSKTKVLQRLIMGAMIQSLQQLTGDNYFFYYGTTIFKAVGLSDSFET
SIVLGIVNFASTFVGIYVVERYGRRTCLLWGAASMTACMVVYASVGVTRLWPNGQDQP
SSKGAGNCMIVFACFYIFCFATTWAPIPYVVVSETFPLRVKSKAMSIATAANWLWGFLIG
FFTPFITGAINFYYGYVFMGCLVFMFFYVLLVVPETKGLTLEEVNTMWEEGVLPWKSAS
WVPPSRRGANYDAEEMTHDDKPLYKRMFSTK SEQ ID NO: 126 *Saccharomyces cerevisiae* ABC transporter polypeptide sequence
MSSSITDEKISGEQQQPAGRKLYYNTSTFAEPPLVDGEGNPINYEPEVYNPDHEKLYHNP
SLPAQSIQDTRDDELLERVYSQDQGVEYEEDEEDKPNLSAASIKSYALTRFTSLLHIHEFS
WENVNPIPELRKMTWQNWNYFFMGYFAWLSAAWAFFCVSVSVAPLAELYDRPTKDIT
WGLGLVLFVRSAGAVIFGLWTDKSSRKWPYITCLFLFVIAQLCTPWCDTYEKFLGVRWI
TGIAMGGIYGCASATAIEDAPVKARSFLSGLFFSAYAMGFIFAIIFYRAFGYFRDDGWKIL
FWFSIFLPILLIFWRLLWPETKYFTKVLKARKLILSDAVKANGGEPLPKANFKQKMVSM
KRTVQKYWLLFAYLVVLLVGPNYLTHASQDLLPTMLRAQLGLSKDAVTVIVVVTNIGA
ICGGMIFGQFMEVTGRRLGLLIACTMGGCFTYPAFMLRSEKAILGAGFMLYFCVFGVW
GILPIHLAELAPADARALVAGLSYQLGNLASAAASTIETQLADRYPLERDASGAVIKEDY
AKVMAILTGSVFIFTFACVFVGHEKFHRDLSSPVMKKYINQVEEYEADGLSISDIVEQKT
ECASVKMIDSNVSKTYEEHIETV

SEQUENCE LISTING (126 sequences)

SEQ ID NO: 1 - protein, 1633 aa, Cyberlindnera jadinii
MSGERCSRFWDFDDLSPCAREELIGTQWPLVLLCASVATITVKGVYNYVHLGKRVSLRDDGESEPLLTASQGAPLYTESSAEFTEDVKRSHFDSSSLPPVKLNGEPHGCKTLYKRSGVEKVRVAVEELFVLAQLVLQSYRYQNTQSASSLANLLLWLWLLSSTTFRILNLNDKYEKIQAIVPNLWVSNILIYFFLWFPAVLTFRSALLNHTGDDKLYYIVNFSVITLQIFNLATSKVGYRCPQVYLSDQHRKPDPEPFTDLLTLVTFSWVTPMMNQAFKVPLTQDDVWDLKMEDFSYFVLKSFKKFSQGSTLGFSNRVILFFLPFLLVQAFWAVVESLILFAPTILLKRILEFVEDRNTGNLPLAWFYVTLMFASKFFSNLSSGQALFFGRRVCIRLKSVVIGEIYAKALRRKLTTKSSSTDQADAGLDKSPSPVSVNPTEEPEEQDKENETKSANLGAIINLMAVDAFKISEVCAYLHAFFGATCMIIVSIYLLWKLMGWSALVGAFAIIALSPLNFMMSRKLGELQKKALAVTDRRIQKLNETLQSIRIIKFFAWEKKFEEQILKIRDEELEMLKSRSVIWSFLVVLWCILPTIVTVISFGCYIFIDKKVLTTPVAFTALSLFNLLRNPLDQISDMLSFAIQSKVSLDRVSEFLSQEETTKYEQLTHVKNTGRVGFSKASFSWDSTSDADFKLRDLDVDFTVGKLNVIIGPTGAGKTSLLLALLGEMEITKGEVHLPGFLPREDLEIGPDGYTESVAYCSQAAWLLNDTIRNNIVFGSPFNRDRYNKVVSACGLARDFEILKAGDQTEIGEKGIALSGGQKQRVSLARALYSNSRHILLDDCLSAVDSHTALHIYENCIAGPLMKNRTVLLVSHNVALTIKSADFVVVLNNGRITNSGTPEQLLADGALGDDEMIKSTVYSRANSSVDLVQKSKQEEDAVLKVKEALNNMKPIENPEDEELENLKKGKLIEEEQKSEGVVSLEVYKWFFSIFGGWFIVAVLLGLFLVANVINFGQSWWVRKWAKDASNDVHISIAGTLSESQYYGAMSQFIAKPLNVFVFKYHQIQNSMSVLKETNISVYYIIVYGILGVSYALIVGLRIVYGFFMGIKASRRVFAKVLNKILRAKLRFFDSTPIGRIMNRFSKDIESVDQDLIPFIDGAVSCAVSVLFTLAMIMAITPGFLIFAILILVMYYLVAVFYLSSSRELKRFDSITKSPIHQHFSETLVGASTIRAYGIERRFLQENLNKIDENNRPFFYMWITNRWLSFRNDMIGASVIFLAGAFILFSLDKIDAGLAGISLSYAIVFNDTALWIVRLYANVEMAMNSVERLKEYTDVDEEPAEEVPENEPPESWPEHGALEVCDLSLRYAPHLPLVIKNVSFNVEPSNKIGIVGRTGAGKSTIITALFRFLDPETGYIKIDGVDITSIGLKRLRQSITIIPQDPTLFTGTIRSNLDPFGNYSDAFIFEALKRVNLITEDELANQGGSSSGSSSSDENANKFLNLNSDVSEGGGNLSQGQRQLMCLARSLLRDPKIMLLDEATASIDYDSDAKIQQTIRQEFSNSTILTIAHRLRSIIDYDKILVMDAGEVVEFDHPYKLISDKSTTFYSMCVDSGELDVLTQIAKEAFKRTV

SEQ ID NO: 2 - protein, 1346 aa, Kluyveromyces marxianu
MNRLIVETYHSNKIEDPTNLPLPPFDLDIPEATRIIQANWEYECWTERHSILLAVLKSVGGRIAIAVSYEFLRTVLAILQPQILKKFIEAFNPESNELPRLNAYFVAVGLFILNVSCTVLRNQFFINIFQAGMKIRGSLMSMIYQKTFRLSAEARDEKGSGDIMNLMSVDVIRIQRFFENAQTMIGAPTQLIGVLISLYFFLGTATLGGLVSIGIMIPLYSYLTEIYKRMFKAQMKYKDRRIKTISEILNSIKSIKLYAWEKPMLERLGHVRNDLELKNMKKIAIVSNLMSFIWDIVPVFVTSSTFLLFSYLTGQVLTPQVVFPAMTLFGMLNQCVYTIPEMINNIIEIGVSLKRLKSYLLAEELDDSFIERTEANDVDPTVEINNATFLWKSVKQSERSDANDDEEASVSSPGVALRDIEHFSAKRAELTCIVGRVGSGKSTFLKAILGLLPCVPNDATPQIKPKLTIRAKSLAYCPQQPWIMNSSFKDNILFGFKYDEAMYKKTIKACQLVPDLKILPDGDQTIVGEKGISLSGGQKARLSLARAVYARADLYLLDDILSAVDSHVCKNIIEQVLDRNTGLLKNKTVILTTNAINVLQHSNMIYLLKNGMIVEGNSYDSVMSTESANGEKSFLREIIEEYALNEKEKEEQEADTDAESKSKSPRNDSDYLLSSDEDNEEEIIPLQPLVDLENAKATDANAVIAFEEEQEDPQLAKVVSRRASVATLKPRPLIDVNKDDRKTAQKAETKEEGRVKKSVYIAYMKACGFFGVLIVFILMIATKLLGLGNNFWLKYWSESNQTNGGNDHIWKFMIVYSLIGMASAAFDVTRIIVMIFFCSLRAAKQLHNQMAHSVVMAPMSFFETTPVGRIVNRFSTDINSIDEDFKNIVALFLHSVFDYLITITVIVISMPWFLLVNTFLLAIYYYYQMFYVVLSRELKRLTSISYSPVMSLLGETLGGYVVINAYNHADIFNYYHFQNVQTNVNFIFNFRSTNRWLSMRLETMGAFIILITSLMALGTLGTTHPISAGLIGLLMSYVLQISSSLMWIIRMLVNIETTIVSVERVLEYRDLEPEGVRVVEGNTPPKDWPSKGEIKISNYTTKYRANLDPVLKDIDVNIKPQEKIGVVGRTGAGKSTLTLALFRILEPFEGSISIDGIDISTLGLYDLRSRLAIIPQDAQAFEGTVRSNLDPFNYHTDAEVWRALELSHLKPHIERIVKELGDDEEKPADLLQTKISDNGGNLSMGQRQLLCLSRALLNPSKILILDEATAAVDRETDKIIQETIRSAFKDRTILTIAHRIDTVMDSDRILVLDKGELKEFDTPENLLENKESLFYSLCEKGGYLKN

SEQ ID NO: 3 - protein, 1510 aa, Cyberlindnera jadinii
MGDTLDSTDPAAERRSAHYKGLDAQVEGQIQELARALTPMSDVVSGSSSEESDSGSVLSRALSTASTIAPGVNPMGDDLEELDPRLNPDNPDFSSRYWIKNIRAFMDKDEAHYQNYSFGIAYKNLRASGEATDADYQTATLNAPLKFAGQYAKRFLSSKTAKRKSQFDILKHMDGLVRPGEILVVLGRPGSGCTTLLKSIAANTHGFEIGEESQISYDGLSPHDIRKHFRGDIVYQAESDIHFPHLTVWQTLFTAARFRTPQNRIPGVTRDDYAAAMTNVYMATYGLLHTKNTKVGSELVRGVSGGERKRVSIAEVSLAGAKLQCWDNATRGLDAATALEFIRALRTSADVLDTTAIIAIYQCSQDAYDLFDKVSVLYDGYQIFFGRADEAKQYFLKMGWECPQRQTTADFLTSVTSPRERIPRKGYEDKVPRTAKEFETYWKNSPEYTELIAEVDSALNGVDQSTQFYASKHARQARHMRKSSPYTVSFPMQTKYLLAREFQRIRNNIGFHGFSLLANSLMALVLSSIFYNLPSATSSFYYRGAAMFFALLVNGFSSFLEIMSLFEARPIIEKHKGYGLYHPSADALASVLSQIPFKIFTALFFNLIYYFMVNFRREPGYFFFYLFVNILATFTMSHYFRLVGSMSSTLPQAVVPGNIIMLTMILFTGFTIPINYMLGWCRWINYLDPMAYAFESLMVNEFYNRIFECSSYIPGNPADNPSWPSDSWVCNVVGASAGETYVNGTLYLETSFRYSHGNKWRNVGILIAFMIALLAAYMLFSEYNESAKQKGEILLFQRSTLRKLKREKALNDIETGKERDITLEPEEEDVNVDVIQAGKDIFHWRDVHYTIKIKSEYREILSGVDGWVKPGTLTALMGASGAGKTTLLDVLASRVTMGVVTGSMFVNGHLRDSSFQRSTGYVQQQDLHLETATVREALRFSAYMRQPSSVPKQEKNEYVEEVIKILDMQKYADAVVGVAGEGLNVEQRKRLSIGVELAAKPKLLLFLDEPTSGLDSQTAWSICQLMRKLANHGQAILCTIHQPSAILMQEFDRLLFLASGGRPVYFGDLGDHCQTLIDYFENHGSPKCPPDANPAEWMLHVIGAAPGSHANQDYHQVWLESDERKEVLKELEYMEKELVKLPYDPTAEQEEFATSIPYQFVTVVKRTFQMYWRTPSYTWAKLFLASSSPLFIGFVFFNADLSLQGLQNQMFALFMILMIFNPTIQQQLPMFVRQRDLYEVRERPSKTFSWTAFMAAQIAAEIPWSFVLGTISYFAFYYPAGFYHNAEPTNQVNQRGAYAWLYMCLLFIFTSTFGNMCIAPLELADSAGNVVSLSFTLCLTFCGVLVGPDQLPGFWIFMYRVSPLTYFIDGFLSNALGNAKVTCSQDELRVLNPPESNMTCSEYLGEYLESAGTGYLTDGSSTSDCEMCPMSTTNDFLSTINCSYSRKWRNLGIFCAYIVINVVGAVLFYWLARVPKKKNRVKEKSPFASSSSADSENKDVDSNLEKVTTQ

SEQ ID NO: 4 - protein, 1264 aa, Sclerotinia sclerotiorum
MMKQGYKKYLTEDDLWNLAKRDTTKACSETFEESWEYEIEHKKNPSLWVAIFRSFSGPYFRGALFKTVSDSLAFIQPQLLKLLIKWVKSRSSDEPQPVIRGAAIALAMFSVSVGQTMALHQYFQRAFETGMRIKTALTAAIYKKSLKLSNEGRASKSTGDIVNYMAVDTQRLQDLTQYGQQLWSAPYQILLCMISLYQLVGLSMLAGVAAMILMIPINGLIARLMKKLQQEQMKNKDSRTRLIAEIINNMKSIKLYAWSSAFMAKLNFVRNDQELKTLRKIGAAQSVANFTWSTTPFLVSCSTFAVFVLTNDSPLTTDIVFPTLTLLNLLTFPLAILPMVITSIIEASVAVKRLTSFFTAEELQPDAVILKGPIEDDGEESLTIRDASFSWDRNSDRHVLQDIHFSAHKGELTCIVGRVGAGKSSFLQALLGDLWKVKGQVVVHGKTAYVAQQPWVMNASVKENILFGHRFDPTFYDKTVKACALTDDFAQLPDGDETEVGERGISLSGGQKARLTLARAVYARADIYLLDDCLSAVDQHVGRHLIDNVFGSTGLLSGKTRVLATNSIPVLKEANLICLIRDNKIIERGTYDQAIARRGEIANLINTSENKDVSTDSETTEASDSSTILDYEQPGEEEAKDEAEEAQEHLTQLQPIRPGGSGVKKRKGSSNTLRRASTASFRGPRGKLRDEEDPLKSKQGKEHSEQGKVKWDVYAEYAKTSNLAAVLIYLAMLVGAQTAQISGSVWLKSWAEANDKLGINRDVGKYIGVYFAFGIGSAALVVIQTLILWIFCSIEASRKLHERMAFAIFRSPMSFFETTPAGRILNRFSRYVVVISVSTPAFIALIIPLSGVYYWVQRYYLRTSRELKRLDSVSRSPIYAHFQESLGGIGTIRAYRQQQRFTQENEWRVDANLRAYFPSINSNRWLAVRLEFLGSLIILSAAGFAIVTVSAGGDLSSGLVGLAMSYALQITQSLNWIVRQTVEVETNIVSVERVLEYARLPSEAPEVIHRHRPPISWPASGGVNFNNYSTRYREGLDLVLKNINLDIKPHEKIGVVGRTGAGKSSLTLALFRIIEPSEGNISIDALNTSTIGLLDLRRRLAIIPQDAALFEGTVRDNLDPGHVHDDTELWSVLEHARLKDHVSTMNGGLEAKIQEGGSNLSQGQRQLVSLARALLTPSNILVLDEATAAVDVETDALLQTTLRSPLFAKRTIITIAHRINTILDSDRIVVLEQGQVKEFDSPKKLMEKRGLFWKLVREAGLEAM

SEQ ID NO: 5 - protein, 1381 aa, Cyberlindnera jadinii
MASPGSEKCTPRSDEDLERSEPQLQRRLLTPFLLSKKVPPIPKEDERKPYPYLKTNPLSQILFWWLNPLLRVGYKRTLDPNDFYYLEHSQDIETTYSNYEMHLARILEKDRAKAREKDPTLTDEDLKNREYPKNAVIKALFLTFKWKYLWSIFLKLLSDIVLVLNPLLSKALINFVDEKMYNPDMSVGRGVGYAIGVTFMLGTSGILINHFLYLSLTVGAHCKAVLTTAIMNKSFRASAKSKHEYPSGRVTSLMSTDLARIDLAIGFQPFAITVPVPIGVAIALLIVNIGVSALAGIAVFLVCIVVISASSKSLLKMRKGANQYTDARISYMREILQNMRIIKFYSWEDAYEKSVVTERNSEMSIILKMQSIRNFLLALSLSLPAIISMVAFLVLYGVSNDKNPGNIFSSISLFSVLAQQTMMLPMALATGADAKIGLERLRQYLQSGDIEKEYEDHEKPGDRDVVLPDNVAVELNNASFIWEKFDDADDNDGNSEKTKEVVVTSKSSLTDSSHIDKSTDSADGEYIKSVFEGFSDINLTIKKGEFVIITGPIGSGKSSLLVALAGFMKKTTGTLGVNGTMLLCGQPWVQNCTVRDNILFGLEYDKDRYDRVVEVCALGDDLKMFTAGDQTEIGERGITLSGGQKARINLARAVYANKDIILLDDVLSAVDARVGKLIVDDCLTSFLGDKTRILATHQLSLIEAADRVIYLNGDGTIHIGTVQELLESNEGFLKLMKFSKKSESEEEENVEAANEKDVSLQKAVSVVQEQDAHAGVLIGQEERAVNGIEWDIYKEYLHEGRGKLGIFAIPTIIMLLVLDVFTSIFVNVWLSFWISHKFKARSDGFYIGLYVMFVILSVIWITAEFVVMGYFSSTAARRLNLKAMKRVLHTPMHFLDVTPMGRILNRFTKDTDVLDNEIGEQARMFLHPAAYVIGVLILCIIYIPWFAIAIPPLAILFTFITNFYIASSREVKRIEAIQRSLVYNNFNEVLNGLQTLKAYNATSRFMEKNKRLLNRMNEAYLLVIANQRWISVNLDLVSCCFVFLISMLSVFRVFDINASSVGLVVTSVLQIGGLMSLIMRAYTTVENEMNSVERLCHYANKLEQEAPYIMNETKPRPTWPEHGAIEFKHASMRYREGLPLVLKDLTISVKGGEKIGICGRTGAGKSTIMNALYRLTELAEGSITIDDVEISQLGLYDLRSKLAIIPQDPVLFRGTIRKNLDPFGQNDDETLWDALRRSGLVEGSILNTIKSQSKDDPNFHKFHLDQTVEDEGANFSLGERQLIALARALVRNSKILILDEATSSVDYETDSKIQKTISTEFSHCTILCIAHRLKTILTYDRILVLEKGEVEEFDTPRELYSKNGVFRQMCERSEINSADFV

SEQ ID NO: 6 - protein, 1422 aa, Candida haemulonis
MDQRRQKRLLTPFLSKKVPPVPYDDERIVYPKRPNIFSAIFFWWLHPVMSTGYKRTLDTADLYKLNDENEVEAMTARFEGIFERRLHDARQKHIAAKCKARGETIENSSVPAEEDLEGYQPPKLLCAWAILETFKWQYGLACLYNTLANTAAVTNPLLSKKLIQFVERHAMGLDTQTGKGVGYALGASFMVLIIGILINHGFQNAMLTGAQVKGVLTKAFLDKSFRLSDRARHDYPASKITSMMGTDLARIDFALGFQPFLVSFPIPIAVAIGILIWNIGAPALVGIGLVFLFLGFIMVFTGKLFAYRKKANKYTDARVNYIKEVLNNLKIIKYYSWEEPYNDVIGENRAKEMNIIYKMQVGRNVILSSAMCLTLFASMASFLVLYATSGSTKDPASLFSSISLFNSMAQQVIMLPLALATGSDAAVGIMRAAQFLAAEEVDANATAIYAPPETRDQMEKDGLSISIKNASFEWESFDNSSDDDEDEVKPKNDLEITEKGEAKENQGQSDDKSSSSTNTMKESDAEPKLTTYSTGSSTMEATIFTGLSNIDLSVQKGEFIVITGLIGSGKTSLLNALAGFMKRVAGHVDVNGSLLLCENPWIQNTTVRENILFGEEFDQDTYDSVLYACSLESDLEILPAGDQTEIGERGINLSGGQKARINLARAVYANKDIVLLDDVLSAVDARVGKHIMNNCLLGLLKDKTRILATHQLSLIGAADRVVFLNGDGTVDVGTLEDLRKTNAGFEHLMKFSSESADDDEEETSPEEALGEDPEIEEREMIERQLSQKQSTIPDEEAERHDYNVNEKQDGRLMSQENRAVNRIKGVVYKRYIKYGSGIFKYYTGVPIIITLTIVAVFCQLFTNTWLTFWSDFKFDGKDNGFYIGFYVMFTVLAFIFLSSEFIIVAYMTNEAAKVLNLKAVSRVLRAPMSFMDTTPMGRILNRFTKDTDTLDNEIGNQIRMLIYFLSNIIGVIVLCVIYLPWFAIAIPFLGAIFVSVGNFYQASAREIKRLEATQRSFVYNNFNETLSGMNTIKAYKAQTRFRKKNSTFIDNMNEAYYLTIANQRWLAIHLDLIAMLFAIIICFLCIFRVFDIGPAATGLLLSYVLQIAGQLSMLVRTYTQVENEMNAVERICEYAFHLEQEAPYTYENSVLPPSWPEEGGIRFINASLAYREGLPNVLKSLNMDINPLEKIGICGRTGAGKSSIMTALYRLAELNEGSIEIDGVDIGSIGLRDLRSKLSIIPQDPVLFRGSIRKNLDPFGASPDDVLWDAMRRAGLIEASKLSTIRNQSKSSENLFKFHLDREVEDNGSNFSLGERQLISFARALVRGSKILILDEATSSVDYETDSKIQETIKREFNDCTILCIAHRLKTIVNYDRILVLDKGEIKEFDTPWNLFNSKHSIFQQMCEKSNITKEDFVARDR

SEQ ID NO: 7 - protein, 1716 aa, Candida pseudohaemulonii
MSVPVIPTTPIARKRLVNASFDNYNEEEDPTFVDEPTEVSDSEDLISVISNVLLSDDDSVETKGGNGDIKNLSTPAQKETWKEWAIRHEVPRKLLHLLIGPFSLWLYTLGATMNQILWPLVFLTAVLFINDYVRLHNPEVNKVMTRVFGLILRQSEINGYNGTLFYALGVLLVFTSAPKDIAVMAVLLLSWADTAALTVGRLWGKYTPKVMPGKSLAGCLASFATGVFLCYLFYGYFCVAYAHVNKPGMIFWTEETSKMSLHVYAIATGLAASILEASDIGGIDDNFIIPVMSAILLYVLKRLLTPFLSKKVPPIPYEDERIVYPKRPNFISAVFFWWLHPVMSTGYKRTLQTQDLYRLNDENEVAAMTARFEGIFERRLSNSRRKHIAAKCKARGETPETSSVPAEEDLADHQPPKMLCAWAILETFKWQYGLACLYNTLANTASVTNPLLSKRLIQFVEKHALGLDTQVGKGVGYALGASFMVLLIGILINHGFQNAMLTGAQVKGVLTKAFLDKSFRLSDRARHDYPGSKITSMMGTDLARIDFALGFQPFLVSFPVPTAVAIGILIWNIGAPALVGIGLVFVFLFAIMVLTGKLFQYRKKANKYTDARINYIKEVLNNLKIIKFYSWEEPYNDVIGENRSKEMNIIYKMQVGRNIILSLAMCLTLFASMASFLVLYATAGSTKDPASLFSSISLFNSLAQQVIMLPLALATGSDALVGIFRAAQFLSAEEVDANATAIYAPPDVQDEMDYQNLAISLKGACFEWETFDQNDDDEEENDEKNPESKKDSKNEKGTIEELQADNKLSLSTNTAKESEVEPKLTTYSTGDSTMEATIFSGLSNINLDVQKNEFIVITGLIGSGKTSLLNALAGFMKRVSGSVDVNGSLLLCETPWIQNATVRENILFGEEFDQEKYDSILFACSLESDLEILPAGDKTEIGERGINLSGGQKARINLARAVYANRDIVLLDDVLSAVDARVGKHIMNNCILGLLKDKTRILATHQLSLIGAADRVVFLNGDGTVDIGTFDELKKSNPGFDHLMKFSSESAEEEEEETLPEEALGEDPEVEDREMIQRQLSQKQSTVPDEEAERHNYNVNEQQDGRLMSQEGRAVNRIKGVVYKNYVKYGSGVFKLYSGVPIVITLTIFAIFCQLFTNTWLTFWSEFKFDGKDNGFYIGFYVMFTVLAFIFLSSEFVIVAYMTNEAAKVLNLKAVSRVLRAPMSFMDTTPMGRILNRFTKDTDTLDNEIGNQIRMLIYFLSNIVGVIILCVVYLPWFAIAIPFLGMIFVSVANFYQASAREIKRLEATQRSFVYNNFNETLSGMNTIKAYNAQERFKKKNSTFIDNMNEAYYLTIANQRWLAIHLDIIAMLFAIIICFLCIFRVFDIGAAATGLLLSYVLQIAGQLSMLVRTYTQVENEMNAVERICEYAFHLEQEAPYTFENSNLPATWPEQGSISFVNASLAYRPGLPNVLKSLNMDIKPLEKIGICGRTGAGKSSIMTALYRLSELNEGMIEIDGVDISKLGLRDLRSKLSIIPQDPVLFRGSIRKNLDPFGASPDDDLWDAMRRAGLIESSKLSTIKNQTKSSDNLFKFHLDREVEDNGSNFSLGERQLISFARALVRGSKILILDEATSSVDYETDSKIQETIQREFTDCTILCIAHRLKTIVNYDRILVLDKGEIKEFDTPWNLFNLKHSIFQQMCEKSSITKDDFAHKG

SEQ ID NO: 8 - protein, 836 aa, Metschnikowia fructicola
MSRKAGHVDIVGSLLLCGVPWIQNTTVKDNILFGNALDEKKYQDVIYACSLESDLEILPAGDQTEIGERGITLSGGQKARINLARAVYANTDIILLDDVLSAVDARVGKHIVNSCLLGLLGDRTRILATHQLSLIGDADRIVFLKGDGTVEVGLMDDLKRRVPEFRELMAYNAETKDDDEDEGSDSEDPDMEVKEFIAKQVTRQSTAVDEEAAHHDYGVNEDKDGRLIMDEAKAVNAIQFGVIKDYVKYGSGVFKYYSIVPVIVVLTMLAVFCQLFTNTWLSFWTGLKFPGKSNGFYIGFYVMFTVLAFVLVTVQFMVLAYLTIKASTTLNIMAVERVLRVPMSYMDTTPMGRIINRFTKDTDTLDNEIGNQLRMVVYIFSNIVGVLILCVIYLPWFAIAIPALVAIFVAISNFYQASGREIKRLEAVQRSLVYNNFNETLSGMDTIKAYRRENMFVDKNSTLINRMNESYYITIANQRWLAIHLDVVATILALVVSLLCVFRVFDISASSVGLLLSYVLQIAGQLSLLVRMLTQVENEFNSVERICEYAFKLPEEAPAFVSETKPHESWPSRGEIRFENASLAYRPGLPLVLKNLNLDIKPTEKIGVCGRTGAGKSSIMAALYRLSELESGRIEIDGVDISQLGLHSLRSKLSIIPQDPVLFKGTIRKNLDPFGDSSEADLWTALVRAGLIEQSKLAYIKAQDQSSDNLHKFHLNREVDDDGANFSLGERQLISFARALVRGSKILILDEATSSVDYETDSKIQSTIVREFQDCTILCIAHRLKTILNYDRILVLDKGEIKEFDTPWNLFNSSQSIFQQMCHKSNIVADDFVRKD

SEQ ID NO: 9 - protein, 1351 aa, Wickerhamomyces ciferrii
MSSLWSNIDLEKSNAHIQPSRPVKRLLTPILTKKIPPIPQESERTSYPFYRTNILSKAFCTWLLPLLSKGYKRTLQQEDLWKLDEHTSIDYVYTNFEKHLNDEMSKFDSKHQDDEESFPRFAIFLALVKTFKYEYSIAIITKFISNALNAFAPLISKRLINFISEKALYPDTPINKGVGYSIGLTFMLMFSAIFMNQSLLHSKLVGGHSKTLLTKTLIQKSLVSNSETKFHYPSGRIISFMSADLQRIDQSIYELPTGLTIIEPIIIAIILLLINIGVSALAGIAVFFLTLTVMAIPAISLFKIRKRANVFTDERINKMREVIQSLKMIKFYSWEDAYEEMITNIRSKESSLVLKFQFIVNLVITIAINSSSITAMGAFLVLYAVDSQGNPATVFSSLTLFGILSTQIIELPMVFSSAAEGLLGLSRVTKFLRSPEETFDLENYYNDELIKDEKTSILIENGNFEWPLFNEKSQDEKPNKKLKKSNSWFSKKKVETTVEEVIESDDSTIGKESKNFKLSNINLKISKGEFIVITGPTGSGKSSLLSAISALMNKTHGEIGINGSNLLCGSPWIQNTTIRENIIFGSKFDREKYDEILKVCSLKHDLQNLSAGDLTEIGERGVTLSGGQKSRVNLARAIYADKDIYLFDDILSAVDANVGKHITENCLLGYIKDKTRIITTHQLSLINKADRIVFLNGDGTVDIGTESELRSQNKEFVQLMVFNEDSRIEIENKDQIDYKTQNQTEKNVTTSHEKPLESDGTLIKAEERAVDSIPLSLYKQYIHAGQGIFGYSAVPLTLIFVIFAVFTKLFVNVWLSFWVSYKFKNLTNGEYIAIYVMITALSVIFVSIELSIMGYVFTESSKNLNLKAMKKVLHSPMSFIDTTPVGRIINRFSKDTNSLDNEIGMQLKLFVYYSSSIIGILIMCIIYLPWFAIAVPFLIIFFLCITNFYQASSREVKRLEAINRSFVYNNFNEVMNGMNTIKSYGAQSRFIAKNDLLNDHLNEVYFVVVANQRWIAVSLDIMATGIVLIVTMLSLTGQFNINASSVGLLTYYMIELSRMLSTLMQTYSEVENDMNSVERVCQYANNLEQEAAYKKLDYQPRPTWPEEGSIEFKDLSLKYRDDLPLVLKKLSISIKGGEKIGICGRTGAGKSSLMVALYRIAESFEGQVLIDGIDISKLGLYDLRSKLSIIPQDPVLFQGTIRSNLDPFNNNTDEELWDALKRSGLAGREDDKFHLESIVEDEGANFSLGERQLLALARALVRRTKILIMDEATSSVDYKTDSFVQETITREFSDCTILCIAHRLKTIINYDKILVLEKGELEEFDKPLELFQRQGVFRDMCIASNIGADDF

SEQ ID NO: 10 - protein, 1386 aa, Debaryomyces hansenii
MLSNKVPPLPLDEERKQYPEKRVNLLSRIFFLWLLPVLNTGYKRTLKPEDMFKLTDDIRIETMYARFYKILEASLKKAKQKHIVQKCKERGETVETNSVDEEDDMSDFKLPKALTVIAVLKTFKWQYLKSCFYLALANGGMTANPLQTKKLISYVEMKSLGYETGIGKGLGYSFGSAGVVLVTGILINHFFYNSMLTGAEAKAVLTKAILDKSFRTNPETKHKYPAGKVTSMMGTDLARIDFAIGFQPFLFTFPVPIAVAIGILIYNVGATALVGIGLLFVFMAAITVATKKLFEYRSKANAYTDSRVDYIKEVLNNLRIIKFYSWEPPYHENISNIRREEMKIIYRMQVLRNIIVSFAMSMNLFSSLVTFLVLYAINSNDRDPASIFSSISLFAILSQQVIMLPMALATGVDAFIGLQRVGAYLASGEVDMEANKIEATGEALALMEKSNTSIEIRNASFEWDTFEDEENSAESEHKEITSHSSDSDSSKELTKSLSGSNSEEITFPGLREINLSIRKNEFVVITGLIGSGKSSLLSAMSGFMRRSSGEINVNGSLLLCGYPWVQNETVRENILFGCEYDEEKYKNVIYACSLESDLEILPAGDNTEIGERGITLSGGQKARINLARAVYADKDIVLLDDVLSAVDARVGKHIMNNCMLGLLKDKTRVLATHQLSLIGTADRIIFLNGDGTIEVGTLEELNANNPDFNKLMAFNGQTNDSDDEEEEENEVIDDDEIVENEKELIQRQLSKTQTHKSAIQDDESTKRDYNKNNTNDGKLFEEEEKAVNGISFDVYKNYVKHGSGIFKHFGIVPLLISSIILATFCQLFTNTWLSFWTEYRFSSKPDRFYIGFYVMFTILAFLFLTLEFVLLAYLTNRASRSLNVIAVDKVLHAPMSFMDTTPMGRILNRFTKDTDVLDNEIGDQLRLLFFMFSNIVGVFILCICYLPWFAIAVPFLVFIFVAVANYYQSSAREIKRLEAVQRSHVYNNFNETLNGMNTIKAYKADNRFLDKNDRLINKMNEAYYITIANQRWLAIHLDIIASLMALLVALLCVNRVFNISASSVGLLLSYVLQIAGQLSMLIRTFTQVENEMNSVERICNYAYNLPEEAPYFITENTPHPEWPRNGGIKFENASMAYRPGLPLVLKDLNLDIKPTEKIGICGRTGAGKSSIMTALYRLSELESGKIMIDDVDISHLGLKDLRSCLSIIPQDPILFRGTIRTNLDPFKEHSDETLWDALRRSGLIDDSRMKNIQKQEKENDVLHKFHLDQGVEDEGSNFSLGERQLIAFARALVRDSKILILDEATSSVDYGTDSKVQTTIAREFSNCTILCIAHRLKTILHYDRILVLDRGEVQEFDTPLNLFNMDNSIFQQMCQRSNIVLDDFQK

SEQ ID NO: 11 - protein, 1458 aa, Lachancea mirantina
MPTIRQELRHSSSGSENEKAESLYVKNEGKLDKVATQNSYYEVDRNRPETFMNSDDLEKVTESEIYPQKRMFSFLHSKKIPPIPTDEERPVYPLFHANWISRIFFWWVFPILRVGYKRTLQPGDLWKMDDRMSIETLYADFERYLEVYREKARVQYRKEHPNATEEEIIENAVMPKHTLVKVLLYTFKWQYFLAFAAMALSNAASAFLPMVTKRLIDFVSEKSFYPGLKVNAGVGYAIGSCVMMLLNGVLFNHFFHNSQLTGVQAKSVLIKAILTKSMKLSGFSRHRFPSGKITSIMSTDLSRLELAIIFQPLLGAFFVAVAICIVLLIINLGPIALVGVGIFVVAMFFSAYAFKRLISVRKKTNIFTDARVTMMREILNSMKMIKFYAWEDAYEASVHDQRSKEISKTRIMQFTRNFVTALAVCLTNISSMVTFLALYKVRNHGRTPANIFSSLSLFQVLSIQMFFLPMALGTAVDGSIALNRCQELFEATEEEHDIDVDFPPCDDPDLALKVVNGSFEWQDFEAEENRLATLMEIEEKKKKKTKSKKDKAPEPKHEAASIKPGHLSDTERESFKGFHNLNFEVKKGELIIITGSIGTGKTSLLNALAGFMRKTEGDVYKNGSLLLCGYPWVQNATVRDNILFGSPYDKARYKEVIRVCSLQADLDILPANDKTEIGERGITLSGGQKARINLARSVYKSMDTYLFDDVLSAVDARVGKHIMDECMLGRLGNKTRILATHQLSLIDRASRVIFLGTDGSFDFGSVTELKKRNAGFNKLMEFANKSSDKEEGELDSTEASGDDVSTAEELEHFRDDDGQREMDASRLKKELSKRSYESSVDENEAAGRLMAKEERAVNSIGFDVYKNYISAGVGKKGFVLLPFYVILLAVTTFSLLFSSVWLSFWTEDKFKRQAGFYMGMYIFFVFFNYFCTTGQFTLLCYLGLTASKMLNLKAVKRILHTPMSFIDTTPIGRILNRFTKDTDTLDTELTESVRLFVYQTANIIGVVIMCIIYLPWFAIAVPFLVIIFALVANHYQSSSREIKRLEAIQRSHVFNNFNEVLGGIDTIRAYRGQERFLMKNDFLTNKMNEAGYLVVAVQRWVSIALDMIAMAFALIIALLCVTRQFHISPSSVGVLLTYVLQLPGLLNTLMRAMTQGENDMNSAERLIAYATDLPLEANYRKPEMTPAEPWPSHGEIVFDDVSLAYRPGLPLVLKNVSIDIGSGEKIGICGRTGAGKSTIMTALYRICELHSGTVSIDGVDISKIGLYDLRSKLSIIPQDPVLFKGSIRRNLDPFNERTDEQLWDALVRSGAVEASEIAEVKAQSPETSGAYANMHKFHLRQEVEDDGSNFSLGERQLLALTRALVRQSKILILDEATSSVDYETDAKIQAKIVQEFSSCTILCIAHRLNTILDYDRILVLEQGSVAEFDTPKALFRAGGIFTEMCQRSGITSADFKEN

SEQ ID NO: 12 - protein, 1405 aa, Puccinia graminisf.sp. Tritici
MNSKPQETPPSSSKISKPKLSYPRRFDRASKGAQLKHIAPSPAPPIVHSSMDQVELIPELKASILSILTFQWIQPLLSQGYRRPLVETDLWALDHDRQSDILSDKLLENYRKRQLAAQKDQPAGDPKHLAKASLVRALNDTFFRRFWIAGLCKLISDGFVACTPLVNRALIEYGNSVYRHKLNPDTTPPPHSKAHGYGLAIGLFLMQASSTFFLHQFFYLSMSVGVLSRSALIAAIYKRSLSFSSRSRKQFPTSQLVGHISSDVSRIDVCMGLFHMSWATPIQLAAILAILVLQIGPSSLAGVGFILMLLPLQIAAMGLMFSLRMKVVSWTDKRTRKTQEVLQGVKLLKLFGWEEAFLSIIDRFRVKELNLLHKALVVLAASLALANSFPLLGSVIAFVTYSAMGHGAGNPEAVFTSLSLFNLLGLPLLILPIALGSIADARSGIQRLEKVFEAEVVEEQDEIFVDSTLDASIRVTKSSWVWEPNNADDGDQEKKPDNPIADLSIDDQKNPTHPNPANVTSSFRLTDIEMDIKRGSLTAIVGPIASGKSSLIQALIGEMQQISGSPPSFGGQVSYCPQNAWIQNDTIRDNIIFGSEMDEKRYQAVIHAACLQADLDMLPQGDMTLIGEKGINLSGGQKQRINIARSIYFISDIILFDDPLSAVDAHVAKHVFEHAIRGSNYTAGHSGIGNQTKILVTHALHLLPKVDEIICMNDGKIQERGTFEELLAAGGTFCALYRDFAGGQHQQNHAANQTPEKAETEISTKSPTEKDHNQSVDDRVDHIPKNEPSGKIEGDDDLNQMQQEERVTGSVPWSVYKHLFTAGNGKWLGPLLVISVVFEQSAVVLSSYWLVWWQNAKIQISQATYMGVYASLGIFQTLSGFAMGAVGVTIGFYASKNLHHGALKAITRAPLAFFDTTPLGRIMNRLSKDVDSIDNKLNDSMRMVLTTLSQVIGAIILIGITSRYFLLAMAGVTAGCWLLATFYRPSARDIQRLNNLLRSKLYAQFTESLNGITTIKAYGMKAKSIVKHCRLLDHETRAYYLTTVNQQWLGIRLEGFGSILVFIVAIISVAQAGSINPSQIGLILTYVQTISQSLSWLVRQIAEVENSLNSVERVLWYQKNVPQEAAALLPDTDPDTTWPSGGSIQFDSIVMSYRPGLPQVLKGLSIDVAAGEKIGVVGRTGAGKSSLMLALFRTTELESGSIKIDGVNIREIGLDRLRRSISIIPQDAILFEGTIRTNLDPFDEYDDQSLWDALSRSGLNQKNAYLGETKEKYGLDSVIEDEGVNLSVGERNLVSLARALVKNSKIIVLDEATASVDFETDAKIQETIRKEFGDKTLLCIAHRLRTVINYDKIVVMDGGRAVEIGTPLALYDQETGIFRNMCESSSITRQDIVSSRGSHSSVGDT

SEQ ID NO: 13 - protein, 1517 aa, Cladosporium fulvum
MSAPDAERPWTANTDTPGPYDTNHADPLAEEPLERVTHEKDLSEEKVLDFEALEETSSNSDSDLGKKHRRPEVESSQSNWTAGTETSVATSLAPDPEEESPRKRTWSQRLNPLKRKPPPPVPKERLPSREHEAGWFSVYTFQWISPLMSVGYQRPLETNDIWAVNPDRSVEVMKARLYTNLEKRRAQPGRINPLVMALYDTFKKEFWIGGITNLFGALLQVLSPFVMKYLIAFAGRAYRAQLGQIPAPHVGEGIGLVLGITAMQICQSSCINHFIYRGMIVGGQCRSVLISVIFEKAMILSGRAKAGGKAHASEEDLKPDFAPGSKEEKAWYKKQLGSGKKGVSGDGQGWGNGRIVNLMSVDTYRIDQACGMGHMIWTSPIQILLTLALLCINLTYSALAGFAFICVMMPLLARAIRSLMARRKFINKITDQRVSLTQEIVSSVRFVKYFGWETSFLERLNEIRTREINKVSFLLSIRNGIMAVSMSLPIFSSMLAFITYSTTQHVLNPAPVFSSLALFNALRIPLNLLPMVLGQVVDANESITRISEFLAAEEANDDSNWDNDAENAISIEHAEFTWERNTKNESDGAPGQNPKGEKQRKLEAKQAKKDAEAEAKEDKWRSKLIEKGELDALPTPSSTTSLAEEARPFRIRDIDLNVGRDELVAVIGSVGSGKSSFLAALAGDMRKTSGSVTFGANRRAFCPQSAWIQNATVKDNITFGRDYNKKWYNDVVDACALRPDLDMLPAGDMTEIGERGITVSGGQKQRLNIARAIYFDADIIIMDDPLSAVDAHVGRHIMDNAICGLLKGKARVLATHQLHVLHRVDRIVWMKDGAIHKIATFPQLMESDQEFQELMKTTAAEETKEDVEEVLEDEIEDEKTNAKKKKGKKPAAALMQNEERAVKSVGWGVYVAYIKASGSIMIAPLILFLLIISQGANIMTSLWLSYWTSGRFGLSLGIYIGVYATLGVVQALLMFAFSVTLTVYGTRASKTMLDRAMYRVLRAPMSFFDTTPMGRITNRFSKDVDTMDNTLTDSMRMFFLTMAMIVSVFILIIAYYYYFVIALIPLTICFVLAAGYYRASARELKRHEAVLRSVVFSRFSEAVNGQATIRAYGVQKRFADNVDEAVDSMDGAYFLTFANQRWLSTRLDVLGNLLVFTVGILVVTSRFTINPSTGGLVLSYILSIVQMIQFTVRQLAEVENNMNSTERIHYYGTQLEEEAPLHLGDVRPTWPEKGGIDFDNVQMRYRDGLPLVLKGLTMKVRAGERIGIVGRTGAGKSTILSTLFRLVELSGGSITIDGVNIAKIGLHDLRSRLAIIPQDPTLFRGTIRSNLDPFNEHTDLELWNALRQADLVGAEQTIEDEAGRIHLDTPVEDEGLNFSLGQRQLLALARALVRGSQIIICDEATSSVDFETDQKIQKTIVRGFQGKTLLCIAHRLKTIIGYDRILVMDQGNVAELDSPISLYDQGGIFRSMCDRSGIRRQDFFNSEEARFGAESPALERTQSAMFQQPEQAYVKEG

SEQ ID NO: 14 - protein, 1147 aa, Alternaria brassiccicola
MLKKKEKKQSPKTVAGVAGEGEGWGNGRIVNLMSTDTYRIDQASGFFHMIWTAPVGILITTALLLVNLTYSALPGLGLILIAMPLLGRAVKTLFRRRVAINKITDQRVSLTQEILQGVRFVKYFGWETSFLERIQTIRKKEIHGIQILLTIRNAVLSVGMSMPVFASMISFITYSQVNANLDPAPIFSSLALFNSMRIPLNFLPLVIGQVIDANASVKRIQEFLLAEEAEESGTWDYNAKDAVTLKGANFTWERHPTQDAEEGAGGPPGKKPTRQEKKENKANAKLAQTSGESAPSDATAVEEEKPFEVKGLDLKIGRNELVAIIGGVGSGKSSLLAALAGDMRKTSGEVIFGASRAFCPQYAWIQNATVRENIIFGKEFNRKWYDQVVDACALRPDLDMLPHNDATEIGERGITVSGGQKQRMNIARAIYFNADIVLMDDPLSAVDAHVGRHIMDNAICGLLKDKCRILATHQLHVLSRCDRIIWVDQGEVKAVDTFDNLMAQNADFVQVMSTTAKEDEKEEEEEEEVDEDEVEAEVKSTKKQRKQKKQAALMQQEERATKSVSWEVWIEYIKAGGGLWVGPLVFILLVLSQGANIVTSLWLSYWTSDKFGYSEGAYIGAYAAFGFSQALFMFFFSFSVSIFGTRAGKVMLHRAITRVLRAPMSFFDTTPLGRITNRFSKDIDVMDNTITDAMRMYFLTLAMIISVFILIISYYHYYAIALGPLFIFFMFSAAFYRSSAREVKRHEAVLRSTVFSRFGEAVMGTPTIRAYGLQNQFSKSVRDAVDDMNSAYYLTFANQRWLSVRLDIVGILLVFTTGILVVTSRFSVDPSIAGLVLSYILTIVQMIQFTVRQLAEVENNMNSTERIHHYGSQLEEEAPLHMGEVRPTWPEHGEIVFDKVEMRYRDGLPLVLKGLSMHVRAGERIGVVGRTGAGKSSIMSALFRLQELSGGSIVIDGVDIGKIGLHDLRSKLAIIPQDPTLFKGTVRSNLDPFHEHSDLELWSALRQADLVSNEQSMDDHSGRIHLDSVVEEEGLNFSLGQRQLMALARALVRGSQIIVCDEATSSVDFETDAKIQQTIVDGFKGKTLLCIAHRLKTIINYDRICVMDAGLIAELDSPLNLYDQGGIFKGMCDRSGIKREEIAGAAK

SEQ ID NO: 15 - protein, 1421 aa, Wickerhamomyces ciferrii
MVDVEQQTVYPEGYNKDDMILQKRLMTPLLSKKVPQIPNQDERKRYPYMHSNYISRIFFWWIIPLLNIGYKRTLTSNDLYKLEDDMSINHTYPIFESHLNKIVAKSRSKALKKNPNLTEEELENIPYPKYSLVKALFLTFKVKYSLAIIFKALADIAQTLNPLLTKALINYVEERVYKPSTPLGKGIGYAFGVAFVLLANGILINHFLHNSLTTGAHCKAILTTALLKKSFNADAKTRHTYNAGKVTSLMGTDLARIDLAVGFQPFAITFPLPVIIAIVLLIVNIGVSALAGIAIFIISIAIIGASAKRLLLMRKSANQYTDKRIGFMREILQSMKIIKFYSWEDAYQKNVTEQRNKEVSIIFKMQTIRNFLMAYSVTLPTFTSMVAFLVLYGVKNDRNPANIFSSLSLFSALANQVLMLPMALATGADAMIGIGRVREYLQCPDGKPLENNEDFDNNDGSQMINEKLAIKVKNASFEWEEFPEVEEIKPIGKEKKGLRSRFQKKKKVDELDEKSNVILETSTSTDQSLKTNDQEINSDPETTAAYTKNVFKGFHDINFEIKKGEFIIVTGPIGSGKSSLLTALSGFMKKTQGNLGINGSLLLCGQSWVQNATVRENILFGLEFDEVRYRQVLKVCALTDDLKSFTGGELTEIGERGITLSGGQKARINLARAVYANKDVLLLDDVLSAVDARVGKHIMDNCLVDYLHGKTRILATHQLSLVNDADRIIYLNGDGTINMGTVDELLATTPGFVTLMEYSKKSQDEENSEDDDDGKPEVIGEADVTLQATKSNTVSEKAGNAETGALIKAEEKAVNQTSWKVYLTYLKAGNGIFGIFASPLAILSLVIEVFCGLFVNVWLSFWIEYKFKTRSDGFYIGIYVMFVFLYTGFSSCTFVLMGYITIFAAKVLNLRAMQKILHAPMSYIDTTPIGRIMNRFTKDTDALDNETGEQIRLFLHPTFSVGGILIMCIIYLPWFAIAIPPLGVVFVCVTNYYQSSSREIKRLEAVKRSFVYNNFNEVLGGMNTIKAYNASDRFILKNSELLDNMNEAYFLVIANQRWISIHLDAVACVLSLIVSLLSVSRQFNISPASAGLVVTYTLNMAGLLSLILRAYTQVENEMNSVERLCHYANDLDQENAYRKPETQPSSNWPEFGSLKFQNVSLRYRDGLPLVLKNLNVNIKGGEKIGICGRTGAGKSSIMTALYRLSELAEGDIIIDDINIKQLGLYELRSKLSIIPQDPVLFQGSIRKNLDPFDEHDEDKLWDALRRSGLIEDEQVLEVIKKQDKLDENFHKFHLNQQVEDEGANFSLGERQLLALARALVRDSKILILDEATSSVDYETDAKIQTTIANEFKDCTILCIAHRLKTILGYDRILVLEQGEIEQFDEPVTLFNEVDGIFRQMCDRSDIKSSDFLKDSYVYNSS

SEQ ID NO: 16 - protein, 1352 aa, Komagataella phaffii
MSSLNSSSKEDDSASLEKQILPEMARQKRLFSFLLPSTIPPLPTDQERKPYPAGVQFSDIPYHQWVPAFISRIFFWWVVPLLKTGYVRTIFPNDLYYLERSLKVEALADKFKKVYQKEVDKRASPNEPMKLTTFMKPLFKTIGVYYFYAIGFKIIFDCGTTLAPLLTKELIKYVSLKSVGVEPGIGKGVGYALGASFLIIVPGICLNHSLYYSTLCGQVLYSVLNKMVLEKSFRLDGVAEHNYPIAKINSMLGTDLSRLELAFTFSPFMMTIPVTMAIAITLLIINIGVSALAGLGMFFLCLVIVFSAIPLIIKIRIKIMGSTDKRVSHIKELANYLKFVKFYSWENSYFSSLTNARTTEMKYTFRMHAIRNSLTALAVSTPALSSMLAFVVAHAVSRDRTPAEIFSSLSLFNVLSMIVFLLPMCLFLSADALLGLKRVCNFLQAPEAHLYDEQETLKTDVALQAKNGTFYWETFENEDDTVAIDHKTTENNKAFSRLKNINLEVKKGEFLVITGLIGTGKSSLLAALSGQMKRESGSVSHQGSLLLCGEPWIQNTTIRENIVFGQPFDETKYWEVIKCCALTQDLDMLDHGDITEVGERGITLSGGQKARINLARAVYNDRDILLMDDVLSAVDARVGKHIMDNCIMGLLHDKTRILATHQLSLISTADRICFLNGDGTIDVGTFEELSARNQNFTNLMVFNSESSESKDEEKELKLIKSTTLTIEEKLPRFHDINDGKLMKKEQRAINGIPIDVYKTYISMGSGVFGKLFSPMFILVVAVTTFCQLFTNVWLSFWTSNRFSHLSEGIYIGIYIMFTFLSMITVTTEYTLIAYLTNKASTKLNIAAMKRFLHVPMSYLDTTPIGQIINRFTKDTDTLDNEIGEQFRMVVYPSANVIGVLIMCIAYLPWFAIALPFLFLLFLLICSFYQATAREVKRIESIQRSFVFSHVNEVLNGMHTIKSYQREDSFISKNDLLLNNMNEASFITNVAQRWLAVILDTIGAGFAFLITMLCVTRQFDIGPSSVGLLVTYLFQIVGQMSLLIRSITQLENNMNSVERLYEYSYNLPQEASYDSPSRPSPPSTWPENGVIDFKDVSLRYRPGLPLVLKNINIHIPSRFRVGICGRTGAGKSSIMTALYRINELAGGQIVIDDVDISTLNLYDLRSNLSIIPQDPVLFKGTIRKNLDPFGEKEDDVLWAALLKSGIVESSSELEQVKLQKKKGQEELHKFHLDQVVEDEGSNFSLGERQLIALARAIVRDSKILILDEATSSVDYKTDAKIQSAIVREFNKCSILCIAHRLKTIVNYDRILVLEAGQVAEFDTPWRLYHKSSGIFRAMCEKANIMEHDFDNRS

SEQ ID NO: 17 - protein, 1414 aa, Issatchenkia orientialis
MSALNTDALESQPDFKFQRQKRLMSPFMSKKVPPIPTKEERKPYGEYHTNILFRIMFWWLNPILNVGYKRTLTEQDLFYLDNSQTMDTLYETFKSHLKTTIEKSMKKYLQEKYSKEGKTYDPSSIPTAEDLKDFQIPIYAIPLCLFKTLYWQYSLGNLYKVLSDCTSATTPLLQKKLINFVQMKSFTALGSTGKGVGYAIGVCLMIFFQAITVNHAFHNLQICGAKSKAILTRMLLDKSMSVDARGNHFFPASKVQSMISTDLNRVDLAIGFFPFALTCVFPIAICIGLLIWNVGVSALVGIAIFVANVGLLAVSIPRLMRFRIKAMVFTDKRVTLMKELLKNFKMIKFYSWENSYARRIQDARFKEMKLILSLQSLRNIVMSVSFAMPTLASMATFCTAFDITSGKNAASLFSSLSLFQVLSMQFMLAPVALNTAADMMVSMKKFNQFLAHADLDPEQYRIEEFHDDKLAVKVDNATFEWDTFDDDKVEDPALEFEKQDNDSLEKVSSHNTVDYDSTEKIRNDTSSIDSTKILEKTAFPGLRNINLEIKKGEFVVVTGSIGAGKSSLLQAISGLMKRVSGKVYVDGDLLLCGYPWVQNATIRDNILFGLPFDQEKYDQVVYACSLQSDFNQFQGGDMTEVGERGITLSGGQKARINLARSVYADKDIILLDDVLSAVDAKVGRHIVDTCLLGLLKDKTRIMATHQLSLIDSADRMIFLNGDGSIDCGTISELKDRNEKLNELLSHQKDKANDSDEELELQEEIESKEQHLKEDLSEVKHEIKEEQKKMEISGDVGEEFEHADEHKEIVRIIGDEERAVNALKADVYINYAKLAFGKLGLFSLMLFVTVAALQTYCMFTNTWLSFWIEEKFHGRSKSFYMGIYIMFAFLYTFFLAAFFYSMCYFCNRASKYLNYKASEKILHVPMSFMDISPIGRVLNRFTKDTDVLDNEILDQFRQFLSPFCNAIGTIVLCIIYIPWFAIAVPLIVTFYVLVANYYQASAREIKRLEAVKRSLVFGHFNEALSGKETIKAYRAIDRVKQRLNKLIDGQNEAYFLTIVNQRWLGANLSILSFCMVFIISFLCVFRVFNISAASTGLLLTYVINLTNTITMMMRAMTQVENEFNSVERLNHYAFDLVQEAPYEIPENDPPQDWPKYGEIIFKDVSMRYRPELPFVLKNINLSIGKGEKIGFCGRTGAGKSTFMTCLYRISEFEGTIVIDDVDISKLGLHKLRSKLTIIPQDPVLFVGSIRENLDPFGEYSDEELWEALTISGLINKEDLNEVKKQNENDDNLNKFHLIRMVEDDGVNFSIGERQLIALARALVRKTKILILDEATSSVDYATDSRIQKTIATEFDDCMILCIAHRLNTILNYDKIVVMDKGEIVEFDKPRSLFMREEGVFRSMCEQANITIEDFP

SEQ ID NO: 18 - protein, 1467 aa, Clavispora lusitaniae
MTVGSSPEPREPFSSDPFFSDPFSPQPFTSPQNTHDNYSREYSRATTPQSSSSNDSENTFVGTPMKHNARDSSDEEASVGMPDLQVQKRMFTFLFSKKVPPVPLPEERREYPWKRARYASRMVFFWLWPVLIKGYKRTLVADDLWYLPTELTVEDMHRRYRENLDKILATRKDKEEEWPVWAVPLALYKTFKFDYTLSCIFLAISFVCQALSPLITRRLIDFVQDRYFGLETTYNKGIAYTIGAVVLIFINGLLLNHFFHKAMATGACVKLVLTKDVLVKSFALLAQLRRRFPAGQITSLMSTDLLRVDLAVGFQPLVVCFPIPVVIAVVLLLHNIGVTSLVGIGLFFVSLVACVLLTSKLFFTREAVVEHTDERIGLMREVLAHLKVIKFYAWELAYKANITKVREREMRYLFTIKVLRNFITAYAVTLPTLTSMVSFVTMWATGNMKQTGQVFLSLSLFSILAQAIMLLPIALATGADATIGFRRLREFLSAEEQGASGIEKPHAEWALQVEDADFQWGGGDGADEMDEKDEETKKWKRQTAEQTAEQTAERETPQVRRPAHVYRPDIARPAQNIRISVPRDDLADISTAEIATAQVARNIRNNRNNGNSTDNGNSTDNRDNKTKGFHLAHVTLAIPAGNFVVVTGAIGSGKTTLLHALAGLMEKTHGKFAARETLLCGAPWIQNATVRQNILFGRPMDWARYHAVLHACCLQQDLRELPGGDQCEIGERGVTLSGGQKARLSLARAAYRGAPVMLFDDVLSAVDARVGKHIATHLFHGLLQGCTRIVATHQLSLVRSADQVVFLGDRIEVGRPRELLARSAGFRLLMAHDSTDTHTNGGLDGDDGLDTANSDFDDDTLGSDNLSNASLRRKSDQFSAIVAEDVAVNAVSWDVYRQYIVLGAGVFGRLAVPVFLFLVALATFCQLFTNTWLSFWMEGKFRLLDRFYVAFYVLFAVLTVFVTGIQFTMLAYMNNRSAELLNVRAMEKVLHAPMSFMDTNPMGRVLNRFTKDTDSVDNEIGEQLRLFIFPAATIVGIIILCICYLPYFAIAVPFLAGVFVFLSDVYSGSAREIKRLEAVQRLVVYNNFNETLTGMATIQAYRAEQDFVAKNDRLLDRMNEAYLLSIATQRWLCVHLDVIALMFALVICMLCITEQFNISASLTGLLLNYVIQIVGLLSLTVRAMTQVETEMNSVERLHDYAFHMPQEAAYEKAESRPAPEWPMAGYINFRDVSLRYRPQLPLVLKDLSFGVYPGEKVGICGRTGAGKSSLMTALYRLTELESGQITIDGVDIAHIGLRDLRSQLLIIPQDPVLFQGTVRRNLDPFGEYSDSVLRDAMRRAGGVLEKFALDRAVDDDGGNFSLGEKQLVALARALVRGLKILILDEATSSVDYATDARIQETIAREFSHCTILCIAHRLKTILNYDRILVMDQGRVVEKGTPWALYQQKGVFSLMCHKAQIGEEDFGK

SEQ ID NO: 19 - protein, 1374 aa, Metschnikowia bicuspidata
MTELQLQNRLLTPFLPKTVPPIPEENERPEYPTTLNPLSYLFFWWLHPVMRVGYKRTLEPADMFTLNEDIKVETLTRRFQGIFKRRLDTAQHQHVLAKIKQRSETSETSSVSFAEDVRDLELLKHFLTVALFLTFKWQYSLACIFLVLASVGLSTAPLLSKKLIEFVELRALGADVSIGSGVGYALGSSFLVLVIGLLLNHTFQKSMLTGAQTNAVLVKAILDKSFRLNGQLRHDYPVSKITSIMSTDLARIDFALGFQPFLVSFPVAVGITIGILCDNIGAPAMRANKFTDSRVNYMKEVLSNLKMIKFYSWEAPYFDRITENRTDEMHIIFNMQMVRNTIVSVATSLTLFASMASFLVVYATLGSTQSPAEIFSSVSLFNSLTQQVFMLPLALSTAADAAVGIQRVAGFLAAEETDTLALETDVRPEMVEYMDRKKLAVKISNATFKWDSYQSAEPELTSSDSGTLHGDKLSKSGKHVPLAALGKLDVSSSSSSEALEATIFDSLRNIDLEIRKGEFIAITGLIGTGKSSLLNAIAGFMSRKDGAIDTVGSLLLCGAPWIQNTTVKENILFGSPLDEKRYQDVVYACSLESDLKILPAGDQTEIGERGITLSGGQKARINLARAVYADKDIILMDDVLSAVDARVGKHIVNSCLMTLMAEKTRILATHQLSLIGDADRIVFLKGDGTIEVGLLDDLQLRVAEFRELMAFNARAKDEEEDEENVPDGNAEKELIAKQLTRQSTAVDEEKVRHDYDANKHNDGRLIMDEARAVNAISFDVVRNYIKYGSGVFKHYSIVPLLVLLTMISVFCQLFTNTWLSFWTELKFPGKSNGFYIGFYVMFTILAFVFITIQFLLLTYMTIKASKVLHIKAVEQILRVPMSYMDTTPMGRIINRFTKDTDTLDNEIGNQFRMVVNIFSTIVGVLILCVIYLPWFAIAIPALVAIFIVVSNFYQASAREVKRLEAVQRSLVYNNFNETLGGMETIKAYKKETMFIDKNSTLINRMNESYYITIANQRWLAIHLDFVATILVIVISLLCVFRVFDISASSVGLLLSYVLQIAGQLSLLVRMFTQLENEFNSVERLSEYAFRLPQEAPALISETTPHESWPDTGMIRFENASLAYRPGLPLVLKSLNMDVKPREKIGVCGRTGAGKSSIMAALYRLSELESGKIEIDGIDISQLGLHTLRSKLSIIPQDPVLFKGTIRKNLDPFGESSEEELWTALTRAGLIESGKMALIKAQAQLSDNLHKFHLEREVDHDGANFSLGERQLISFARALVRGSKILILDEATSSVDYETDSKIQSTIVREFEDCTILCIAHRLKTILHYDRILVLDKGEIKEFDTPWNLFTLKDSIFQQMCSKSNIVAEDFLERE

SEQ ID NO: 20 - protein, 1410 aa, Clavispora lusitaniae
MDHESAAFSLRAPPLRQNRLLSPLFSRKVPPVPQDHERHTYPLYGNPILWFFFTWLWPVMITGYKRTLEPNDLYKLNDKLKADALAARFEAIFARRLAEDKRRHLEQAQDSSKILNSSKNLLNSPDLADLADLADYVPSDTLCLWSLFETFKWQYLTACFLCALAQVGWTCNPLLSKKLIAYVQRKALGIELDTGKGVGYALGVSLVVFCSDILFNQMYYLSSLTGAELKAIFTKVMLDKSFRLNARSRRVYPASKITSIMSTDVSRIDLGLATAPMIIVAPVPLAISIGILIHNLKAPALLGIGIMILFLGFAGFLGSLLFKYRKLATTQTDARVSYMKEVLNNLKMIKFYSWEKPYMAMIKAVREKEMTFLLKMQVTRSIIISVAVSLSLVASFASFMLLYGTASASKRNPASIFSSVALFNILALVFINLPLAIAGATDAYIGMRRVGQYLASDEHVEDEKRVTSETDRQLMEEKNLAITVSNANFEWEIFDIPDEEKIKEEKKKQKDKEKNDKKNKKKKLSLDESSHEAVTKLEKPTSAATFKLRNIDLTIMKGEFVVVTGLIGSGKSSLLLALEGSMKRNSGQVKTNGSLLMCGAPWIQSSTIRENVIFNNPYNKSWYEQVIDVCCMDSDLEILPAGDQTEIGERGITLSGGQKARLSLARAVYARSDIILLDDVLSAVDAKVGKRIVDECILGVLRKKTVVLATHQLSLIESADKIVFLNGDGTVDVGTSESLRRSNEAFQKLLSHSTTEKYAEEESSISSQTDESIKKVVVEAQISRLTSVSSTNEKTDLQKQNEGKLIMEEEKSVNAIDADVYVRYIFAGIPGVKGAMIFAAVIIFSILSVFFNLFTSTWLSFWVEYKWRNRSDGFYIGFYAAFTVLALVTLAFGFLGVIYVMNLSSRTLNIRAAERILYVPMSYMNVTPMGRIINRFTKDTDVLDNEMGDRMGMIIYFASIIGGVLILCIIYLPWFAIAVPFLIVVFFGFANFYQASGREIKRLEAVQRSLVYNNFNETLTGLDTIRGYDKTDVFLSKNIRLIDKMNEAYFITVANQRWLDVAVSFLATIFAIIISFLCVFRVFKINASSVGLLLSNTLQISGIITTLVVVYTRVEQDMNSAERIIEYVDDLPQEAPYIISETTPNSAWPQEGQIDFNHVNLAYRPGLPMVLKDFTVHIDPNEKIGICGRTGAGKSSIMVALYRMVELTSGNITIDGIDIRTLGLNNLRSKLSIIPQDPVLFQGTIRKNLDPFGLATDEQLWETLRRARIIKSEDLDEVKSQMDPSKMHKFHLDRDVDVDGENFSLGEKQLIAFARALVRGSKILILDEATSSVDYATDKILQEAIVEEFSDCTILCIAHRLKTILNYDRVMVMDQGQVVEFDKPINLFKKQGTFFQMCEKAGINEKEFGH

SEQ ID NO: 21 - protein, 1414 aa, Candida intermedia
MSEKPARHILTPLLLKKVPPIPTDDERRVYPKKMNPFSWIFFWWINPIMMAGYKRKLAPEDLYKLNDDIQVKTMTDNFSMHFQKQVAKAEQKHLAAKLKARGESSVNLSKSLTEDLEDFKVPKLIVIWTLMHTFGYQYFKACFFLMMSLVAQTCNPLLSKELIKFVQLKAMGLDPHMGKGVGYAIGTSFLVVTSGILINHAFHSSMLTGAQVKGVLTKAMLDKSFRLSDGSKHKFPTSKITSMMGTDLARIDFALGFQPFLFTFPIPIAISIGILCHNIGASAMVGVGLVFTYLISVMILTGKLFKFRRSANKYTDTRVNYIKEVLNNLKMIKFYSWETPYSKMIGENRSKEMHIVYLMQVGRNLITSGAMVLTLFASMAAFLTLYAVSNNTKSPAALFSSVSLFNSLAQQVFMLPLALASGSDAIVGVIRAGEFLAAEEVDKAATTIDASPEMKEEMDKRNLALKVDHASFKWETFESDKTSLKEEALDEKHPNDNSEDGSNLEKTAAELELESKLERKMTNYSSTSTTLDATIFSGLEDINIEVQKGEFLVITGVIGSGKTSLLNALSGFMKRTAGSVSINGSLLLCETPWIQNATVKENILFGLPLDEKRYKEVIYSCSLESDLEILPAGDQTEIGERGITLSGGQKARINLARAVYAGKDIILLDDVLSAVDARVGKHIMNNCIMGLLKDKTRILATHQLSLIGSANRVIFLNGDGTIDVGSLQSLKETNEAFQHLMAFNSEAKEKEEDVEEETDANEVAETERELIERQLTRQSTKVSKAVTEADEEAMRYEYNTNEEKDGHLMSKERAAENSIAFSVYKRYVKYGSGIFKHYSILPLVVILTAVSVFCQLFTNTWLSFWSEQKFHGKSNGFYIGFYVMFTILALVFLSTEFVILAYMCNKSATNLNLKAVEKILRVPMAYMDTTPMGRILNRFTKDTDTLDNEIGNQVRMVIFFFSNIVGIIILCIIYLPWFAIAVPFLAFVFVAIANFYQSSGREIKRLEATQRSFVYNNFNETMSGMDTIKAYKAQDRFITINENNIDNMNEAYYITVANQRWLAIHLDLVATAFALLICLLCVFRVFQISPASVGLLLSNVLLIAGQLSLLVRTFTQLENEMNSVERICEYAFDLPEEAPYIIPETTPRELWPEQGSIRFENVSLAYRPGLPLVLKNLNLDVGSTEKIGICGRTGAGKSSIMTALYRLSELDRGKIEIDGIDIGTIGLHNLRSKLSIIPQDPVLFRGTIRKNLDPFGESSDERLWDSLRRAGLIEESKLSIVRQQNEDSENFHKFHLNREVEDEGSNFSLGERQLIAFARALVRGSKVLILDEATSSVDYETDSKIQATIAREFKDCTILCIAHRLRTILNYDRILVLDKGEIKQFDTPWNLFNSRDGIFRQMCERSNITREDFQ

SEQ ID NO: 22 - protein, 1381 aa, Cyberlindnera jadinii
MTSPGSEKCTPRSDEDLERSEPQLQRRLLTPFLLSKKVPPIPKEDERKPYPYLKTNPLSQILFWWLNPLLRVGYKRTLDPNDFYYLEHSQDIETTYSNYEMHLARILEKDRAKARAKDPTLTDEDLKNREYPKNAVIKALFLTFKWKYLWSIFLKLLSDIVLVLNPLLSKALINFVDEKMYNPDMSVGRGVGYAIGVTFMLGTSGILINHFLYLSLTVGAHCKAVLTTAIMNKSFRASAKSKHEYPSGRVTSLMSTDLARIDLAIGFQPFAITVPVPIGVAIALLIVNIGVSALAGIAVFLVCIVVISASSKSLLKMRKGANQYTDARISYMREILQNMRIIKFYSWEDAYEKSVVTERNSEMSIILKMQSIRNFLLALSLSLPAIISMVAFLVLYGVSNDKNPGNIFSSISLFSVLAQQTMMLPMALATGADAKIGLERLRQYLQSGDIEKEYEDHEKPGDRDVVLPDNVAVELNNASFIWEKFDDADDNDGNSEKTKEVVVTSKSSLTDSSHIDKSTDSADGEYIKSVFEGFNNINLTIKKGEFVIITGPIGSGKSSLLVALAGFMKKTSGTLGVNGTMLLCGQPWVQNCTVRDNILFGLEYDEARYDRVVEVCALGDDLKMFTAGDQTEIGERGITLSGGQKARINLARAVYANKDIILLDDVLSAVDARVGKLIVDDCLTSFLGDKTRILATHQLSLIEAADRVIYLNGDGTIHIGTVQELLESNEGFLKLMEFSRKSESEEEEDVEAANEKDVSLQKAVSVVQEQDAHAGVLIGQEERAVNGIEWDIYKEYLHEGRGKLGIFAIPTIIMLLVLDVFTSIFVNVWLSFWISHKFKARSDGFYIGLYVMFVILSVIWITAEFVVMGYFSSTAARRLNLKAMKRVLHTPMHFLDVTPMGRILNRFTKDTDVLDNEIGEQARMFLHPAAYVIGVLILCIIYIPWFAIAIPPLAILFTFITNFYIASSREVKRIEAIQRSLVYNNFNEVLNGLQTLKAYNATSRFMEKNKRLLNRMNEAYLLVIANQRWISVNLDLVSCCFVFLISMLSVFRVFDINASSVGLVVTSVLQIGGLMSLIMRAYTTVENEMNSVERLCHYANKLEQEAPYIMNETKPRPTWPEHGAIEFKHASMRYREGLPLVLKDLTISVKGGEKIGICGRTGAGKSTIMNALYRLTELAEGSITIDGVEISQLGLYDLRSKLAIIPQDPVLFRGTIRKNLDPFGQNDDETLWDALRRSGLVEGSILNTIKSQSKDDPNFHKFHLDQTVEDEGANFSLGERQLIALARALVRNSKILILDEATSSVDYETDSKIQKTISTEFSHCTILCIAHRLKTILTYDRILVLEKGEVEEFDTPRVLYSKNGVFRQMCERSEITSADFV

SEQ ID NO: 23 - protein, 1477 aa, Xylaria hypoxylon
MANETGEKGAKEADPITEANAPVKPESSTPYDDRDDHDDPEEEIRRREESLDERANREELKRTQSYATDTSTITRTTTRTSVPAASKKPWYKTPNPLLWGSVPPVPKEKQESREASAGFFSRLTFQWMAPLMNVGYKRPLEEGDLWKVNPKRSVDIMASKCSEAFERRIKKGDKYPLLWAIHETFLWEFWVGGLCQLMASIFQVLSPFVLRFLIAFAQEAWDNKKSGQAPPPIGRGIGLVVGVVFMQIFQSLGTNHFIFRGMMIGGQVRAVLISLIFEKSMLISGRAKAGGKAVANGTTEEKIDDSKDDDQEESSKKNSKAKKLGIAGDGVGWSNGRVVNLMSVDTYRLDQSSALFHIVWTAPIQCIITLVVLLINLSYSALAGFAILVIGIPALTRAIRSLFRRRGLINKITDQRVTLTQEILQSVRFVKYFGWEEAFVKRLGEVRDREIHGIQVLLAIRNAINSVSLSLPIYASFLSFITYSLTDHGLGPAEVFSSLALFNGLRLPLNLLPLVIGNIIDAWSSMKRIQDFMLSENQEDTAVFSPENKSAVEIKHASFTWERTPTQGDDKAAAAGKKGAPKKGTKQPTNNDNGAETSESNSDTASTLIDEREPFKLEDLNLAIGRKEIIAVIGSVGSGKSSLLAALAGDMRKTSGEVVLGASRAFCPQYAWIQNASVRKNILFGKNMNREWYKEVIKACALQPDIDMLPDGDATEIGERGITVSGGQKQRLNIARAIYFDADIVLMDDPLSAVDAHVGRHIMDHAILGLLKDKCRILATHQLWVLNRCDRIVWMDGGKIRAVDTFDKLMENEPGFRHLMETTAVEEKKDEDEVVDEEKSDKKDKKKKKKAQGLMQAEERAVASVPWSVYARYVRASGSIFNALWVLLALVIAQGGNIATSLWLSYWTADRFGYSQAVYIGVYAAIGTAQAIFLFIFAIMLTIFGTRASKTLLRQAVTRTLRAPMSFFDTTPLGRITNRFSRDVDVMDNNLTDAMRMYFLTMVTVISVFALIIAFFYYFAIALVPLTIIFVLAASYYRASAREVKRFESVLRSVVFAKFSEGISGVASIRAYGLQGRLVEDLRNAIDDMNSAYFLTFSNQRWLSVRLDLVGNLLVFTTGILVVTSRFSVPPSIGGLVLSYILSIVQMLQFSVRQLAEVENGMNAVERLLHYGTQLEEEAPEHTVDVRPSWPENGEIVFENVEMRYRENLPLVLKGLSMHVKGGERIGIVGRTGAGKSSIMSTLFRLVEISGGHITIDGIDIATIGLHDLRSRLAIIPQDPTLFRGTVRSNLDPFSEHSDLELWSALRQADLVSVDAGPNDKDPGRIHLDSVVEEEGLNFSLGQRQLMALARALVRGSRIIVCDEATSSVDMETDDKIQKTMAVGFKGRTLLCIAHRLRTIIGYDRICVLDAGRITELGTPLELWEIEGGIFRGMCERSGIRHEDLAAATANMGSLGEAPMPASLALEDGANEKAGSL

SEQ ID NO: 24 - protein, 1506 aa, Naumovozyma castellii
MPPPKKANRSSVISSSSLSSSSGDRSITDNSKLDDMIAGETINISPQDPFKDTPELDVTSATSGTISKMVSDDISSMMDSSLLPTGEYKLDRNKPETYLNSDDIEKVTQSDIFPQKRLFSFLHSKKIPEVPSSDDERKEYPLFHANILSQLFIWWVIPIIKTGYKRTVQPNDLFKMDKRMSIETLHDAFQKNMDYYFKKAEQKYLKSHPNATNEELAKHMKLPKWTVLKAIVFTFKRQLFVATVFAILANCTSGFNPMITKRLIEFVEKKTFFHDMTVNAGIGYAIGACIMMFLNGVFFNHFFHLSQLTGVQAKSVLTKAALNKMFRASNYAKHQFPNGKVTSFVTTDLSRLEFAISFQPFLFGFPAVFAICIVLLIVNLGAISLVGIGVFFSAFFACLFIFKQILGLRVVANKFTDARVTLMREILNNMKMVKYYAWEDAYEKNIQDVRGKEINTVRKMLFIRNFVIAMATALPSVASLVTFLCMYKVNNMGRTPGNVFSSLSLFQVLSIQMFFLPIAISTGIDMVIGLGRLQSLLESPEDDPDLQLERLPAPDLNPNVALKMEDGAFEWENYELLDAQEKAEAEEKLKKEIEDYNQKWYHFKKKTMPNPEELAKESTNAIDKTAELKLKKDLMEDKDAIEKIPFNGFHDLNFEIKKGEFIIMVGPIGTGKTSLLNAFAGFMNKVSGRIQINGDLLLCGYPWIQNASVKDNIIFGSPYNKAKYDEVIRVCSLKSDLDILPAGDLTEIGERGITLSGGQKARINLARSVYKQKDIYLFDDVLSAVDSRVGKHIMDECFLGLLKDKTRILATHQLSLLERASRVIVLGNDGSFDIGTVEELKQRSSTLVNLLQFSSQTAEKEEDEENENQEEEMEKLEKQMTEISKVLSRKEAVDGHTTMKEERAVNSISLKIYKEYLKAGVGKWGIVVVPCYLILIMCTTFCSLFSSVWLSYWTEDKFKNRAPSFYMGLYSFFVFFSYILTTSQFTLLCCIGVLSSKWLNLRAVKRILHTPMSYLDTTPLGRILNRFTKDTDSLDNELTESVRMLLYQFANIVGVCIMCIIYLPWFAIAIPFLFVGFVLIADHYQSSGREIKRLEAIQRSFVYNNFNEVLGGMDTIKSYRSENRFIAKSDFLIDKMNEAGYLVVAVQRWVAIFLDVIAVCFALIITLLCVTRAFPISAASVGVLLTYVLQLPGLLNGVLRSLTQTENDMNSAERLVTYATELPLEADYRKPEVSPPEEWPTKGEIHFENVDFSYRPGLPTVLKNLSLDIKSGEKIGICGRTGAGKSTIMSALYRLNEISSGKMIIDDVDISTIGLYDLRRKLAIIPQDPVLFRGTIRKNLDPFNEHQDEHLWNALVRGGAIEQKELNEIKAQKPDEKGNHSEMYKFHLDQLVEEEGANFSLGERQLLALTRALVRQARILILDEATSSVDYETDGKIQARIVEEFGHCTILCIAHRLKTILTYDRILVLEKGEVAEFDTPKTLFAQEDSIFRSMCQRSGITEEDFI

SEQ ID NO: 25 - protein, 1517 aa, Debaryomyces fabryi
MSHIYSSNASIDGEGPVNSPPYDSYLNKYNNTNLLQVTTNNSETTTTFVDNSITSRLAENNKKSPNATPGNENNNSSSNLNLEGQEILHNEKRLFSFLFSKKVPPVTAPEERTIYPWKKANVFSRMMFYWLWPVLYKGYKRTLLPDDLWYLTEELKVESMHERFDVNLNKRLEKDKQKYLKKHNNLDGHVWSPYNIPLALFDTFKLQYSMSCIFLGLSFVCQALSPLITRRLIDFVQNSYETRIFGVEVSYNEGIGYTIGAVVLIFVNGLLLNHFFHNAMVTGAQAKAILTKSLLLKSFSLSSKSRNQFSIGKITSLMSTDLARIDLAIGFQPLVVCFPIPVIIAVVLLLKFIGVTSLAGIGLFVVSLVLCVLLTKKLFTTREEVVLYTDERISLMREVLTNLKIIKFYAWEMAYKVGITKVRTKEMKYLFTIKVLRNFVTAYAVTLPTLTSMVSFTSMWANNSMKGAGKVFSSLSLFSILAQAIMLLPIALATGADALIGFRRCRDYLVAEEYDDDLEERLASDVDKRYIAGDTNSEFEFKHESFDLSETGSYENTNKNANVIEVSHANFIWESFYTENSSSWDLNSSGSLSEKDPKQKKKSKSKDIKYQIKEKDSFQESSRSSNETYCESPSVIEARNFPGLTDINLSVKQGEFIIITGSIGSGKSSLLAALSGFMKLENPSVGKVSIYDDLLLCSDPWIQNATVRDNIIFGKPYDETRYNKVIRACCLEDDIKLLPARDLAEIGERGITLSGGQKSRINLARAAYADAGILLFDDVLSAVDARVGKHIVNNLFNGLLKDKTKVLATHQLSLIESADKVVYLNGDGSIDFGTLNELLARNNQFKRLIEFNTDLTRDNESRKSETQRVYENYSDTDYDNNNGYEGARLIRQQSVVPESSDIAGKIMGDEERATNAISWDIYKKYIDLGSGFFGWSAGPVFIFLISLATFCQLFTNTWLSFWTEKKFPNKSDHFYVALYVMFAFLTVFFTAIEFTMLAYMNNRSAKLLNVKAVEKILHAPMSYLDTNPMGRILNRFTKDTDSLDNEIGEQLRLFLFPLATIIGIVILCICYLPWFAIAVPFLSFAFVFVANFYQGSSREIKRLEAVQRSLVYNNFNETLSGMSTIKAYKVEETFIEKNDRYLNKMNEAYYVSIANQRWLGVHLDIIASIFALIICLLCITDQFHISASSTGLLLSYVIQIVGLLSLTIRSMTQVENEMNSVERLHQYAFHLPQEGAYKKPESKPPAEWPPSGYIQFNNVSLKYRDHLPTVLKNLNFSVYPGEKVGICGRTGAGKSSIMSALYRLVELNEGSIIIDGLNIAEMGLYDLRSKLSIIPQDPVLFQGTIRRNLDPFNESTDEKLWDALRRSGLIDASQISKIKNTKLDQNRNIGHDSLHKFHLDQLVADDGSNFSLGERQLIALARAMVRNSKILILDEATSSVDYETDAKIQETIVNEFSHCTILCIAHRLKTILHYDRILVMDKGSLIEKGTPYNLFTDRNGVFRQMCDKTNIIDEDFQ

SEQ ID NO: 26 - protein, 1477 aa, Saccharomyces cerevisiae
MTITVGDAVSETELENKSQNVVLSPKASASSDISTDVDKDTSSSWDDKSLLPTGEYIVDRNKPQTYLNSDDIEKVTESDIFPQKRLFSFLHSKKIPEVPQTDDERKIYPLFHTNIISNMFFWWVLPILRVGYKRTIQPNDLFKMDPRMSIETLYDDFEKNMIYYFEKTRKKYRKRHPEATEEEVMENAKLPKHTVLRALLFTFKKQYFMSIVFAILANCTSGFNPMITKRLIEFVEEKAIFHSMHVNKGIGYAIGACLMMFVNGLTFNHFFHTSQLTGVQAKSILTKAAMKKMFNASNYARHCFPNGKVTSFVTTDLARIEFALSFQPFLAGFPAILAICIVLLIVNLGPIALVGIGIFFGGFFISLFAFKLILGFRIAANIFTDARVTMMREVLNNIKMIKYYTWEDAYEKNIQDIRTKEISKVRKMQLSRNFLIAMAMSLPSIASLVTFLAMYKVNKGGRQPGNIFASLSLFQVLSLQMFFLPIAIGTGIDMIIGLGRLQSLLEAPEDDPNQMIEMKPSPGFDPKLALKMTHCSFEWEDYELNDAIEEAKGEAKDEGKKNKKKRKDTWGKPSASTNKAKRLDNMLKDRDGPEDLEKTSFRGFKDLNFDIKKGEFIMITGPIGTGKSSLLNAMAGSMRKTDGKVEVNGDLLMCGYPWIQNASVRDNIIFGSPFNKEKYDEVVRVCSLKADLDILPAGDMTEIGERGITLSGGQKARINLARSVYKKKDIYLFDDVLSAVDSRVGKHIMDECLTGMLANKTRILATHQLSLIERASRVIVLGTDGQVDIGTVDELKARNQTLINLLQFSSQNSEKEDEEQEAVVAGELGQLKYESEVKELTELKKKATEMSQTANSGKIVADGHTSSKEERAVNSISLKIYREYIKAAVGKWGFIALPLYAILVVGTTFCSLFSSVWLSYWTENKFKNRPPSFYMGLYSFFVFAAFIFMNGQFTILCAMGIMASKWLNLRAVKRILHTPMSYIDTTPLGRILNRFTKDTDSLDNELTESLRLMTSQFANIVGVCVMCIVYLPWFAIAIPFLLVIFVLIADHYQSSGREIKRLEAVQRSFVYNNLNEVLGGMDTIKAYRSQERFLAKSDFLINKMNEAGYLVVVLQRWVGIFLDMVAIAFALIITLLCVTRAFPISAASVGVLLTYVLQLPGLLNTILRAMTQTENDMNSAERLVTYATELPLEASYRKPEMTPPESWPSMGEIIFENVDFAYRPGLPIVLKNLNLNIKSGEKIGICGRTGAGKSTIMSALYRLNELTAGKILIDNVDISQLGLFDLRRKLAIIPQDPVLFRGTIRKNLDPFNERTDDELWDALVRGGAIAKDDLPEVKLQKPDENGTHGKMHKFHLDQAVEEEGSNFSLGERQLLALTRALVRQSKILILDEATSSVDYETDGKIQTRIVEEFGDCTILCIAHRLKTIVNYDRILVLEKGEVAEFDTPWTLFSQEDSIFRSMCSRSGIVENDFENRS

SEQ ID NO: 27 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 28 - protein, 1453 aa, Kluyveromyces marxianus
MAVSSSESTSSYSDVVHLQKETIPDTEIEILPDDLHSSSTGRRRTGSGAGSLKSASHVKENSVQIRNMYEIDKSKPETYLNHDDLEKVTESKIYEQKRLFRWFHSRKVPPIPETLEERPVYPFRRANVISQLFFIWILPIVSVGYKRTLQPNDLWRMDDKMSIETLYERFDSHMKEFIEKARLEYRKEHPEATDQEVLKNAKLPKAALLKCLFYTFRYQYVTAFIFVLISNAASALTPLLTKKLIAFVEKKSRFHDTKINSGVGYAIGSVLLMMINGIAFNHFFHLSALTGAEAKSLLIKTILHKSMKLSAYSKHKFSNGKITSLMSTDVSRLELAITFHPFLYAFPMVFVIALVLLLINIGVICLVGFAIFFAITFINFGAFKKILQFRLAATSITDKRVAMMREILNSIKMIKFYAWEDAYEENVKKVRAIESRLVKMMQLVRNTLVSLTMAFPNLASMVTFLAMYKVNKGGRSPANIFSSLSLFQIMMIQMFFIPMSISTGIDAYVGLGRVQELLEAEEESDRYIENEEDLVLDDDTVFKVKNASFEWENFEFEEAKELAKEKGESMSFSDRSVDTEKEDPGAEKTRFNGFHDLNFEIKENEFIIITGAIGTGKSSLLNAMAGFMSRTSGSMAVNGDLLLCGYPWVQNATVRDNITFGSPFDQEKYEKVLEICSLEADLDILPAGDNTEVGERGITLSGGQKARITLARAVYKDMDIYLFDDVLSAVDSRVCQHIVEHCMMGYLKDKTRILATHQLSLIGQASRVIFLGTDGSFDIGTVEELLSRNKGFHKLMQFQNSKPVDGDEHSTNDENVFSEEDEESILKKQKSLTVGKKEEDGRIIEKEERAVNALSFKVYKEYVSSGLGKYALMMIPIFLFIVASATFCNLFSSVWLSFWTENKFKHRTTGFYMGLYVMFVLLGIIFMWIEFVSVGTMAVNASKWLNLKALHRLLHAPMGFMDVTPIGRVLNRFTKDTDALDNEISESLRLFIYQTANLTGIIILCIIYMPWFAIAMPFMIFAYVFIADHYQASGREIKRMDAIQRSFVFNNFNEVLGGIDTIKAYRSQERFLMKSDFLINKMNEAGYLVASIQRWVSITLDLLAVVFALIIALLCVTRQFHISPGSVGVLLTYVLQLPGLLNGLLRSQTQTENDLNSAERLVNYAYDLPMEAQYRKLETQPNESWPSEGRIKFEHVSLSYRPELPLVLKDVSIDIKGSEKIGICGRTGAGKSTIMSALYRLTELRSGKITIDDIDISTLGLYDLRKKLAIIPQDPVLFKGDIRKNLDPFQECTDEQLWDALVRGGAIEKSELETVKLQKKDSHGLSGNMHKFHLDQSVEENGSNFSLGERQLLALTRALVRGSKILILDEATSSVDYETDAKIQSRIVEEFSRCTILCIAHRLKTILNYDRILVLDQGEVVEFDKPETLFNDHSTIFYQMCCGAGITAEDFSS

SEQ ID NO: 29 - protein, 1460 aa, Vanderwaltozyma polyspora
MLIGHTSSDSSSAGGDNNGAGNLRNADYDEKDYDKNGLSFQRSVNLSTLNSKSDASTDISYRFLPSGEYKVEANKPKTFLNQDDLEKVTDSEIYPQKRLFSFLHSKKIPPVPQDDDERKIFPLYHANIISRIFIWWVFPIIKVGYKRTIQPNDLFITDKKMSIDAIYKSFEKNMNFYFEKYRNEYKKLHPDATDQEVVENTELPRFTVLRALFFTFKYQYLWAVTCAILSNCASGLNPLLTKRLIEFVEAKALVPSLHVNKGIGYAFGACIMIFVNGVFFNHFFCASQLTGSQAKSVLTKAALSKMFRANGYAKHKFPNGKVTSFVTTDLARIEFAISFQPFLAGFPAALAICIVLLIVNLGPIALVGIGVFFASFFFSLFVFKQIIGLRVTSLIFTDARVTMMREILNNMKMVKYYAWEDAYEKNITDIRTNEIDKVRKMQFIRNFMIALAMSLPNIASLVTFLAMYKVNSSGRTPGNIFASLSLFQILSLQMFFFPIAISTGIDMILGLDRFQNLLEAPEINQKLLDEMAPTSDIDPNTALRMKNASFEWPDYEKIDAEQEAKQKDKNKNKKDKVKKKEESKKPSAKESSPVDLEKFAFSGFKDINLEIHKGEFIMITGPIGTGKTSLLNAMSGLMEKTEGSVQINGELLMGGYPWIQNATVRDNIIFGSPFDKSKYNMVVKACCLDADLDILPAGDMTEIGERGINLSGGQKARINLARCVYKNKDIYLFDDVLSAVDSRVGKLIMDECLLGLLNGKTRVLATHQLSLVENASRVIVLGNDGSVDIGTVEELKKRNQTFITLMEHTTQKQDEDEEQDEEFEIEVKELSELEKNLTKVTTKSEVDGHIINKEERAVNSIGWYIYKSYLKAAVGKWGFLVIPLYVFCVTATTFCSLFSSVWLSFWTEDKFPTRSTSFYMGLYSFFVFGGYIFMTSQFTIVCFIGVNASKKLNLSAVRRILHTPMAFLDTTPLGRILNRFTKDTDSLDNELTENVRLMLAQFANIIGVCVMCIIYLPWFAIAIPFILLIFVLVSNHYQSAGREIKRLEAIQRSFVYNNLNEVLGGMDTIRFYNSEERFMAKSDYLIDKMNEAGYLVVCVQRWVAVLLDMIAVCFALIIALLCVTRQFHISASSVGVLLTYVLQLPGLLNTVLRALTQTENDMNSVERLVSYATELPTEAAYRKPESSPDPSWPQEGKIDFEEVSFAYRPGLPAVLKNLSMSINGGEKIGICGRTGAGKSTIMSALYRLNELESGRIIIDGVNISNIGLFDLRRSLSIIPQDPVLFRGTIRKNLDPFGERSDDELWDALSRGGSIDKESLEEVKTQKSTGNSKVQELHKFHLDQEVEEEGSNFSLGERQLLALARALVRNSKVLILDEATSSVDYETDNKIQNRIIEAFSECTILCIAHRLKTILNYDRILVLEKGEIAEFDSPYNLYKMDGIFTSMCMRSGITEEDFKLK

SEQ ID NO: 30 - protein, 1456 aa, Nakaseomyces bacilisporus
MYDRTDQTKADSTTSTESDEKYIVNEDHDDKNLSSNYYEQLSVSIANELQDSQGLTPTGEYIVDKNKPVTYLNSNDIEKVTDSELFPQKRLFSFLHTKHIPAVPLDDSERTLYPMYHTNLLSQLFIWWVFPIIRLGYKRTVQPNDLFKMDPRISIEKLHADFEHNMDYYFEKARRKLLKENPNATADDINNIKLPNHTVLRALFWTFKYQYLWSVWCAVLANCSSGFNPMITKRLIRFVEEKAFFPNKKVNAGIGYAFGACIMMFVNGVFFNHFFHSSQLTGVQAKSVLIKATMKKMFRANAYTKHKYPNGKVTSFVTTDLSRLEFALAFQPFLAGFPAIIAICIVLLIVNLGPISLVGIGLFFASFVIALILFKQILKYRLAANVFTDARVTLMREVLSNMKMMKFYAWEDAYEENIKDVRAKEIKRVRKMQFVRNFLFALAISLPNIASLVTFLCLHKIDHLGTSNPSNVFSSLSLFQVLSLQMFFLPIALGTGVDMILGLTRLQGLLESPEEQSNHTLEHGNPNGSNVILSVNDASFEWEDFEVQDIKEQKKEEVKATNGKKSKLFFKKSKPQMTKDSPKNEPTEKNDDSTTKMFTKFEKLNFEIKRGEFIMVTGPIGTGKTSLLNALAGFMKRVEGEVDCRGNLLMCGYPWIQNATLKDNILFGSPYIKEKYDEVIRVCSLAADIDVLPAGDMTEIGERGITLSGGQKARINLARAVYKNKDIYLFDDVLSAVDSRVGKHIMDECLLGMLGNKTRILATHQLSLIERASRIIVLGTNGSFDIGTLEELKERNQTLNNLLQYASEEANKEKKTEGDEGDEGDEGANKLTKRNSSIPTNGQTTSKEERAVNSIKLKIYNSYIHAAVGKWGIVVLPLYVLFVIATTFCNLFSSVWLSYWSENKFKNRSSSFYMGLYSFFVFAGYLFMNGQFTILCLMGVTASKWLNLKAVKRILHTPMAYLDTTPMGRILNRFTKDTDSLDNELTESLRLLLSQFANIIGVCVLCIVYLPWFAIAIPFLFLIFVLVADHYQSAGREIKRLEAIQRSFVYNNINEVLNGMDTIKAYNAEERFLAKTDYLINKMNEAGYLVVSVQRWVAILLDMIAIAFALIITLLCVTRQFHISPGATGVLLTYVLQLPGLLNTIMRALTQAENDMNSAERLITYATELPQEAAYKKPEMTPPESWPDKGQITFENVSFAYRPGLPAVLHNIDLNIKSGEKIGICGRTGAGKSTIMNALFRINEVLEGDIHIDGVNISNLGLYDLRRKLAIIPQDPVLFKGTIRKNLDPFHQHSDEELWESLVRGGAIEKDELAETKLQKQDENGSFNQMHKFHLDQMVEEEGGNFSLGERQVLALTRALVRQSKILILDEATSSVDYETDGKIQSRIMNEFGHCTILCIAHRLKTILSYDRILVLEQGRIAEFDTPWKLFSKKESIFRSMCERSSITDGDFIRKE

SEQ ID NO: 31 - protein, 1472 aa, Nakaseomyces delphensis
MGLFNKTTKSSASNNDALTTTESDISIDQKRGSSSSDSPKGQNYELNVNEDSVSILTSGEYAVKRNKPQTYLNSNDIEKVTQSDIYPQKRLFSFLHRKNIPEVPQSDEEREVYPLFHANPLSTFFLWWVIPIVKIGYKRTIQPNDLFKIDKRMSIETLFADFEKNLNFYFEKSRNDYMKRHPDATPAEMLENSHLKKFTVLKVLFFTFKRQYLLSVLLAILANCASGFNPMLTKRLIRFVEEKAYFPHLHVNKGVGYAIGACLMMFLNGILFNHFFHASMICGVQAKSVLIKAAMKKMFKASGYARHKFPNGKVTSFVTTDLSRLEFALSFQPFLAGFPAILAICIVQLIVNLGPISLAGVGVFFGGFCISLFAFKWILALRISANIFTDQRVTMMREVLTNMKMVKYYAWEDAYEKNIQDIRSKEISRVRRMQMLRNFLIAMAMSLPNIASLITFLSMYRVNNDARTNPAKVFSSLSLFQILSLQMFFLPIAIATGIDMIIGLNRLQELLEAPESADPFDPESIVNLVHKNEKKIDPRSDIALAMKDASFEWEDYELNDAEEEKNSKDDKDAKKTNKEHVTELPIEIDNSSNSKMVKESTPGLDKKTFTKFTELNFEIKKGEFIMITGPIGTGKSSLLNAMAGFMPQTSGELDINGHLLLCGYPWIQNATVRDNIIFGAPYNKEKYRTVIEVCSLQADLDILPAGDLTEIGERGITLSGGQKARINLARAVYKNKDIYLFDDVLSAVDSRVGKHIMDECFLGAIKDRTRILATHQLSLIEKADRVIVLSTDGSVDVGTVEELKERNQTLINLLKFSSENKDEEEVIDEEEDEEEDPMKKEMAEIEKEITRKSLAKEGLTMTKEERAVNSIGWNIYREYIVTAVGKWGIVIIPLYAFLIMATTFCNLFSSVWLSYWTENKFPHRQPSFYMGLYSFFVFGGYIFMNSQFTILCVMGIMASKWLNLKAVKRILHAPMSYLDTTPLGRILNRFTKDTDSLDNELTENIRLMLSQFANLVGVCVLCIVYLPWFAIAIPFLLLVFILIADHYQSAGREIKRLEAVQRSFVYNNLIEVLGGMDTIKAYNSQERYLTKMDFLINKMNEASYLVVSVQRWVAIFLDMIAVAFALIIALLCVTRQFKISPAAVGVLLTYVLQLPGLLNTILRALTQVENDMNSAERLVTYATDLPQEAAYRKSDFSPPEYWPRTGEIKFENVSFSYRPGLPIVLKNVNLSIGGGEKIGICGRTGAGKSTIMSALYRLNELTTGKILIDDVDTYKLGLYDLRRKLAIIPQDPVLFRGSIRKNLDPFNEFSDDLLWNSLIRGGAIENEDLAEVRQQKPDDNGSYSNMHKFHLDQVVEEDGANFSLGERQLLALTRALVRQAKILILDEATSSVDYETDGKIQARIATEFRDCTILCIAHRLKTILNYDRILVLEKGEIAEFDTPLTLFNQPDSIFRSMCSRSGINEEDFHEAA

SEQ ID NO: 32 - protein, 1477 aa, Sacharomyces cerevisiae; identical to SEQ ID NO: 26

SEQ ID NO: 33 - protein, 1423 aa, Scheffersomyces stipitis
MEVRLESGSELVRQNRLLSFLLSKNVPHLPTDEERKIYPEGTTNFFYRFFFWWLNPVMRTGYKRTLEPQDLFKLSDDIKIENMANRFYHYFERDLERARTKHVEKKCKERGETLATTKVDPEEDLKDFELSKFTTVFALFKTFKYQYSAACVFLCMANSASTCNPLLLKKLIQYVERKALGVEEGIGRGLGYSFGASAIVFLIGVSINHFFYRSMLTGAQAKAVLTKALLDKSFRLSAEAKHKYPVGKITSMMGTDLARIDFAIGFQPFLIIFPIPIIIAVAILIVNIGVSALVGVAILAFFFCAIAVSTRKLFAYRFTANKFTDARVDFIKEALNNLKIIKFYSWEPPYHENISDIRRKEMRIIYRMQVLRNIITAFSMCLTLFASMISFLVLYAVDKNRKDPASIFSSISLFNVLTQQVFLVPMALSSGADAYLGIGRVGEYLSSSETNLEETRIHADGEKLIEMDKENVAIEIDGAHFEWDTFDDDEEEDLDDEDDKDKAEEGHDEKPKQALSASAKHHTHKETFLEKKDSTKTFVPFPGLTNINLTINKNEFVVVTGLIGTGKSSLLNAMSGFMRRTSGSVNVDGELLLCGYPWVQNATVRDNIVFGSEWDEEKYNNVIYACSLESDLEILPAGDQTEIGERGITLSGGQKARINLARAVYAERDIILMDDVLSAVDARVGRHIMNNCILGLLKDKTRVLATHQLSLIGSADKVVYLNGDGTIDVGTFEELKARNISFANLMAYNSEAKEEEEEEEVEEDEEVVENEREMIQRQLSKVTKPEDEEAEHKDFNKNEHRDGHLTEQEERAVNGINAEVYQQYIKLGSGKFSPWLFCPLLVSLMILSTFCQLFTNTWLSFWTEFKFTNKSNGFYIGFYVMFTVLSFILLTCEFVMLVYLTNTASVRLNIMAIEKVLHAPMAFMDTTPMGRILNRFTKDTDVLDNEIGDQLRFLVFVFANIIGVLILCVIYLPWFAIAIPFLGFLFVAVANYYQASAREIKRLEAVQRSFVYNNFNETLSGMNTIKAYNAEYRFLEKNNELIDNMNEAYYLTIANQRWLAIHMDIIATIFALLIALLCVNRVFNITAASVGLLLSYVFQIAGQLSMLIRTFTQVENEMNSAERLASYAFHLPEEAPYLINERTPAPSWPDKGIVKFDNASLAYRPGLPLVLKNLSFEVKPSEKIGICGRTGAGKSSIMTALYRLSELESGKITIDDVDIASLGLKDLRSKLSIIPQDPVLFRGSIRKNLDPFNESSDSKLWDALVRTGLIDPSRLDIVKKQVKTQSTEDEEGSIIHKFHLDQQVEDEGSNFSLGERQLIAFARALVRDSKILILDEATSSVDYETDFKIQTSIIKEFSQCTILCIAHRLKTIINYDRILVLDKGEIKEFDTPWNLFNISNGIFQQMCQKSNITEEDFANLKNF

SEQ ID NO: 34 - protein, 1458 aa, Scheffersomyces stipitis
MSDYDLEENHLVRQNRLLSSLFSKELPPIPEDDERPEHPERDANFFSKIFFWWMIPVMNTGYKRTLTPKDLFTLSDDIKVETMAARFMAIFTSDVERAKLKHVKKKCKKRGETLESSSVDFDTDVEDFKVSPIMFFFTIWKTYKYQYFAASVCLAIANSAQAVNPLLFKKLITYVGLKAYGIEQGVGKGVGYAIGSCLIEFLGAVLFNHFFYKAMMTGAETKGVLTKALLEKSFRLSAESKHKFPVGKITSMMGTDLSRIDLALGLQPFIFVFPIPIVISIAILIVNIGAVALIGIGVMLLFMAVIGGTTAKLYSYRTKANKYTDIRVSYMKEVLNNLKMIKFYSWEPPYYENISSTRTKEMDIIYNMQTLRSIVTALAMSLTGFASLVAFLVLFAVDNDRKNPASIFSSISLFNVLLTQVFMLPMALATSADAFAGVGRVSTFLTTGEVDPKELETDISADVLQRMDKEDVVIEVNNASFEWEIFEDIEEKDPKKEKEEKKKAKKAAKETKKLAKQAKNSQTITPSEEELSKIDSPKFTEKELSTESKSVEEKVFAGLNNINLSIKKNEFVVITGMIGSGKTSLLNALSGFMKKTSGEVLVSSSLLLCGYPWIQNTTVRENIVFGSEWDEEKYNRVIFACSLESDIEILPGGDLTEIGERGITLSGGQKARINLARAVYGGREIILMDDVLSAVDARVGKHIMNNCILDLLKDSTRILATHQLSLIDSADRVIFLNGDGSISVGTNEELQKSNPGFAALMAHNAKTEEDDEDEKIDVDLDKQKFEEHHEVEKELIQRQVTRASAVDEEAIRKDYNKNVEEDGHLIEDEDRGVNAIALDVYLTYVKLGSGKYTAWGIVPPMLVFMALATFCQIFTNTWLSFWTENKFSGKDDNFYIGIYVMFTVLSFVFLALEFMSLVYMTNTAAVKLNIAAVQKVLKVPMAFMDTTPMGRILNRFTKDTDVLDNEIGEQINFALFMLSNVVGIIILCIIYLPWFAIAVPFLGFMFIAVSNYYQASAREIKRLEAVSRSFVYNNFNEVLNGINTINAYKAESRFVAKNDRLINGMNESYYLTIGNQRWLGIQMNIIAVLFSLLIALLCVNRVFKISPASVGLLLSYVFSIGGTLSMLIRTFTQVENEMNSVERISYYSFSLPQEAPSYITENSPPPEWPAKGEIHFKDTSLAYRPGLPLVLKNLNFSIKGSEKIGICGRTGAGKSSIMTALYRLSELDGGSIVIDDIDISTLGLHDLRSKLSIIPQDPVMFRGTIRKNLDPFDQSTDDQLWGALVRTGLVEADRLDVVKAQVKVQKEDKSDHGDNNNGADKKGAEEGSILHKFHLDQMVEDEGVNFSLGERQLIAFARALVRNSKILILDEATSSVDYETDAKIQNSIVNEFADCTILCIAHRLKTIINYDKILVLDKGEIKEFNTPWNLFKTKDSIFQQMCIKSNIVEEDFHRVSKF

SEQ ID NO: 35 - protein, 1461 aa, Paraphaeosphaeria sporulosa
MSGSGTSSFNEKEVDWRIQDQEAAAVDSKQYESIVNKPLETAKVEKDLEAHVDKQSVRGGRLLSRLHSAQSGASEWSSELSDTKSSASGRKKWYKRMNPLKWGNKPPVPETRLPSREYSAGFFSRLTFQWMAPLMTVGYKRPLEKNDLWTVNPDRSADVMVERLQASFKRRREAGEEKLLLGALFDTFKWEFIIGGACQLFASIIQSVAPFVLRYLISFALKAYIAQHNGGPAPPIGEGIGLVIGITAMQFFQSMATNHFMYRGMMIGGEARAVLISVIFDKAMKLSGRAKAGGKAVLEKPPPDVKAGSEAERRWYHKMLKKKQGKLAQGPQGVSGDGQGWANGRIINLMSTDTYRVDQASGFFHMIWCSPIAILITVALLLINLTYSALPGIGLLIVTMPLLGRAVRSLFRRRMAINKITDQRVSLTQEILQAVRFVKYFGWETSFLERVDAIRRKEIKGIQILLAIRNGIMAVGMSMPVFASMLAFITYSLTDHGLNPARIFSSLALFNSLRIPLNFLPLVIGQVIDANASVKRIQEFLLAEEAQEDTEWNYDAKEAVVIKDADFTWERHPTREDEDGPPGKGAPGKKIKENKDKRKSVQSTASSGSGSATNSAEKAGEEDLPFQLKELNLSIGRKELIAVIGGVGSGKSSFLAALAGDMRRTKGEVMIGASRAFCPQYAWIQNATVRENIVFGKDFRQDWYNKVVDACALRPDLDMLPNHDKTEIGERGITVSGGQKQRMNIARAIYFDADIVLMDDPLSAVDAHVGRHIMDNAICGLLQDKCRILATHQLHVLDRCDRIVWIEEGRIQAVDTFPNLMANNRDFRQLMTMTATEETKDEQEHAIEDEIEDEKKMAQKKKKKKPAALMQEEDRATKAVDWDVWLAYLRAGGGLWVGPIVVALLILSQGANIATSLWLSWWTSNKFGYSEGAYIGVYAALGASQALLMFAFSIAVSVFGTEAGKVMLHRAIHRVLRAPMSFFDTTPLGRITNRFSKDIDVMDNTLTDAIRMYFMTLAMIISVFILIISYYYYYAIALGPLFLVFMFSAAYYRASAREVKRHESVLRSNVFARFSEAVMGTSTIRAYGLEHQFSRSVRAAIDDMNSAYYLTFANQRWLSVRLDVIGILLVFTTGILVVTSRFSVNPSIAGLVLSYILTIVQMIQFTVRQLAEVENNMNATERIHHYGTMLEEEAPLKMGEVRKTWPEHGEIVFQNVEMRYRDGLPLVLKGLDMHVAAGERIGVVGRTGAGKSSIMSTLFRLTELSGGSIIIDGVDISTIGLHDLRSKLAIIPQDPTLFKGTIRSNLDPFNEHSDLALWGALRQADLVSNEATLDDKSGRIHLDSIVEEEGLNFSLGQRQLMALARALVRGSQIIVCDEATSSVDFETDQKIQKTIVDRFRGKTLLCIAHRLKTIIGYDRICVMDAGTIAELDKPIHLYDRGGIFKSMCDRSGIRREDFFTA

SEQ ID NO: 36 - protein, 1381 aa, Wickerhamomyces anomalus
MSSNASVAESKDLVDLEQNILSKQRPVHRLLTPFLTKKVPEIPKESERKPYPLYHTNLLSKFFFFWLIPLLNKGYKRTLLQEDLWHLDEKTSIDYVYERFEANLTKRIVTYHLKNPDLENKDEIPRFAIVMAILETFKWEYFIASFARVLGNIAITFSPLVSRDLINFIQQKSLNPDLKVNKGVGYSIGLTLLLIASAILFNQSLQYAKLVGGHSKTILTKALLNKSLIANAETRYKYPSGKIISFMSADLSRIDLALGFFPLVVAFPVPIIIGIVLLIVNLGVSALAGIAIFILTFIVMSTPASAMFKLRIKANKFTDERVSLMREILQSMKMVKFYSWEDAYEKLVTVIRNKEIKYVFKIQLVINIISTIALNSASITSMGAFLVLYAVRSHGNPAAVFSSLSLFNLLAVQVTNIPIILSYCADALSAIDRITKYLQSPVEFDAVENFYDNSIIDPKSKVAVKIENGEFEWPEFEELKEDDTKDVKKTKPKPKKKWSLFDKKPETSNDAQEVKTESEEKELNELPNESTEEHEKKFSGLHDINLNVYQGEFIVVTGSTGSGKSSLLSAIASFMAKRSGSIGVNGSLLLCGQPWVQNSTVKENILFGEQYDSKRYKSVIEVCALESDLKSLPAGDLTEIGERGVTLSGGQKARVNLARAVYSLNKDIYLLDDILSAVDANVGKHITKYCLMEYIGDRTRILATHQLSLIKKADRVVFVNNDGTIDVGTENELREKNPQFVALMEFNKEHESGDHKENDQIAKVTSVNDEAKPGEENGALFGEEERAYDSIPFSIYKQYAQAGQGVFGFSAFIILLFLMILAVFLTLFTNVWLSFWVGNRFKSLSNGTYIGLYVGFTILSCVFIALEFTMMGYINTEASKVLNLQAVKRVLHTPMSFMDTTPIGRIINRFSKDTNSLDNEISLQLKLFLHFGAVIIGILILAIIYLPWFAITIPFLLIMFLVITNYYQASSREVKRLEAINRSFVYNNFNEVLNGLNTIKAYGAQNRFMKKNDKFVDRLNEVYFVVIANQRWIAVNLDTLAGLIVFIVAMLSVTRQFNISPSSVGLLTYYMIEFSQLLSFISTSYTEVENEMNSVERVCHYANNLEQEAAYRRSEFKPAPEWPTKGEVSFQNVSSRYREGLPLVLNNLSFVVDGSSKIGICGRTGAGKSSLVSTLYRLSELAGGEILIDGVDISQLGLFDLRSKLSIIPQDPVLFQGTIKKNLDPFNEATDDELWDAMRRGGLISTEKFGTIKTQTENQDKFHLNSKVEDEGANFSLGERQLLALARALVRRSKILIMDEATSSVDFETDAKIQKTIAEEFKECTILCIAHRLKTIIKYDKILVLEKGELEEYGEPTELFSKGGIFREMCESSDITADDFK

SEQ ID NO: 37 - protein, 1457 aa, Kerivoula Africana
MGPNINHTVDNIPSNSSSKMDEDDEYYKTSSNTSSLDSSSDEFSYLPTGEYKVQKNKPKTYLNIDDIERVTDSEIFPQKRLFSFLHSKKIKEVPTNDDERPIYPFFHANIISRTFVWWVMPILKVGYKRTIQPNDLFRMDPYFSIEKMSSDFDKNMDYYFQKTYNKYRKEHPNATEDEVYEHAKLPKLTVFKALFWTFKRQYITSCICAILANCASAFNPMITKRLLEFVERKAVLKHMKVNDGIGYAIGACLMMLFNGILFNHFFHNSQICGVQAKSILTAAALNKMFRASKYARHKFPSGKVTSFVTTDLARIEFALSFQPFLIGFPPLLIICIVLLIVNLGAIALVGIGLFFVVAVFVMVIFKKIVDLRMSANTFTDARVTKMREILNNMKMVKYYAWEDAYEKNIQEIRSEEISRVRKMQYIRNGVIALAISLPNIASLATFLSMYKVNNMGRTPANVFSSLSLFQVLALQMFFMPIALATGIDMMIGLGRLQDLLQAPEEHSRLIEDRKPDPEVEKSNIALKLDNCSFEWDDFEELDLLEEAEKKKKEKKKNKKKKDDPKAKTKKSLKKEKENNEIEKAFSKFSNLDFEIRKGEFIMITGPIGTGKSSLLNAFAGFMNKTEGRIQVNGDLLFCGYPWIQNATVKDNILFGSPFIKEKYENVLRVCSLDADLKVLPAGDKTEIGERGINLSGGQKARINLARAVYKTKDIFLFDDVLSAVDSRVGKHIMDECLLDLLEGKTRILATHQLSLIEKADRVIVLGTDGSFDIGTVDELKQRNQTLTNLLDYSTTERENENRDESPVADEENDELLIQEELKIQLLQTTTRNEDAEDVSGGDGHLIEKEERAVNSIGWEIYKQYIIAGVGKWGFVVIPAYILFIVITSFCQVFSSVWLSFWTEDKFPTRSPSFYMGLYSFFVFGGFVFMCVQFTTLCSIGVLASKWLNLNAVHRVLHAPMSYLDTTPLGRILNRFTKDTDSLDNELTESVRLMLFQVGNIVAVIVMCIVYLPWFAIAVPFLFFMFVLIADHYQSTSREIKRLDAIQRSFVYNNLNEVLGGMDTIKSYKGQKRFQAKSDYLINKMNEAGYLLVSVQRWVSIFLDMVAIIFALIIALLSVTGVFSLSASSVGVLLTYVLQLPGLLNSVLRALTQTENDMNSAERLVNYATKLPLEAAYKKPELSPPESWPSKGEIRFLDVDFAYRSGLPVVLKGLNLDIKSGEKIGICGRTGAGKSTIMSALYRLNELTSGKILIDDVDISTLGLYDLRRKLSIIPQDPVLFKGTIRKNLDPFSNYDDSLLWDALIRSGAIEKESVEKVKSEMVNEEGTHTDMHKFHLDQLVEEEGSNFSLGERQVLALTRALVRQSKILILDEATSSVDYETDGKIQKRIVEEFDNCTILCIAHRLKTILQYDRILVLEKGVIAEFDQPFKLFSDKDSIFRSMCERSNITESDFKIQK

SEQ ID NO: 38 - protein, 1506 aa, Naumovozyma castellii; identical to SEQ ID NO: 24

SEQ ID NO: 39 - protein, 1411 aa, Cyberlindnera fabianii
MAKDGIVTSTEAPLKDAESGQLVLERRLLTPLLSKKVPPIPTDEERKFYPFKKANPISKVFFWWLNPIMNVGYKRTLTPQDLFKLTPDMTIDHTYEKFDRYLTKIVEKDRAAALKKDPSLTPEDLERREYPKFAIIKALFLTFKWEYSTAIMFKVFADVCGVCNPLLSKELIKFVSRKTLNADIAVNDGVGYAFGCTLLLAFSGIFINQFLHLSITTGAHCKGILTTALLKKSFRADAETRHKFTSGRITSLMSTDLARIDLAIGLQPFGWTFPIPVIIAIALLIVNIGVASLAGIAVFIISILVIGGSAKALLKMRRGANKFTDKRISLMREILQSMKMIKYYSWEDAYESSVVEQRNSEVGVILKMQSIRNFLLAFSISLPSFTSMIAFLVLYGISSNRNPANIFPSISLFGSLAQQTMMLPMALATGTDAMIGLNRVREFLQSGVDLEDPEAPQGNDQDSQDANVEKLPEDVALSVKNATFIWETFDDEEDEGADKPKADTATEKKDSDIATPATSTKDTHSDSELKNTASSTEEEGHESYTKSVFEGFHNINLDVKKGEFVIVTGAIGSGKSSLLIALAGFMKQTGGTLTAAEDVLLCGAPWVQNTTVRENITFGLPYEEERYERVIDACALRDDLKLFAGGDLTEIGERGITLSGGQKARINLARAVYADKSIVLFDDVLSAVDARVGKHIIDDCFGEYMKGKTRVLATHQLSLVDKADRVVFLNGDGTLHIGTVEELLTSNEGFIKLMEFSKKSSEDDEEEDEDIDEEEQEIIALQKSQSLAVIQSKKNNNDAAAGVLVNEEERAKNKISSKVYTEYLREGGGILGKFAAPIAILLLILDVFTTIFINVWLSFWITYKWKNRSDGFYIGFYVMFVVLNICFIASCFVLLGYISTTSARELNLKAMRRILHAPMAYLDVTPMGRILNRFTKDTDVLDNELGEQLRLFLHPTAFVIGVIILCIIYLPWFALVIPPLLVVFSCVTSYYQSSSREVKRLEAVQRSFVYNNFNEVLNGMSTLKAYRATSRFLKKNNVSVDRMNEAYFVVIANQRWISIHMDMVAVCLLFVVAMLAVTRQFSISAASAGLVVTYVMQIGGLMSLIMRAYTTVENEMNSVERLCQYANDLVQEKPYRINETKPSPSWPESGSIEFEGVSLRYRDGLPLVLRNLTLAVAGGEKIGICGRTGAGKSSIMTALYRLSELAEGRILIDGLDISKMGLFELRSKLSIIPQDPVLFQGTIRRNLDPFGESDDQHLWDSLRRAGLIDSSVLATIKAQGKEDKNFHKFHLDQAVEDDGSNFSLGERQLLALARALVRNSRILILDEATSSVDYETDAKIQSTIKSEFSECTILCIAHRLKTILDYDKILVLEAGEIEEFGTPMTLYENDGIFRQMCDRSDITREDFVHDL

SEQ ID NO: 40 - protein, 1458 aa, Lachancea mirantina; identical to SEQ ID NO: 11

SEQ ID NO: 41 - protein, 1421 aa, Pachysolen tannophilus
MAEDESSSIQVFEKEKNGKSHAMIEEAQPVEYMKQRRLFSFLFSKKVPPIPTPDERKPYPFRKANIIYKIFFWWLMPLMNTGYKRTLQQEDLWYLDGDLKIEEYYAIFEKRLAKRTQKAREAHLKLLEEKKKNGTFDPNEDNEFEFEYPRYSLVWALFDTFKWEYSLSIVFVALADVGFTLNPLLSKALIDFVEDRVLGYKTNIGHGVGYAIGCSALVSVSGILINHFFNLSTQVGAKSKATLTKAMLEKSFKLNAKGRHNYPASKITSMLGTDLSRVDLGIGFQPIAIVFPIPVAISIALLIVNIGVSSLAGIGIFIISTIIIALATKKLFSYRKKITKFTDSRINYMKELLNNVRIIKYYSWEPSYKETIADVRTSEMYNIFKLQILRNFLTAYAVCLPQISSMVSFLVMYAVDKNRSAGQIFASLSLFNVLSQQIMMLPLALATGSDALVGIDRVRGLLQSGEDDPKDRESSYVDVDELIEKKLAISVRNATFQWKTFEQIDESVSPSKEEEEKEKQIEREEERLNNINKQLSGNFDQSSSLSVKHTKFPGLKHLDFDIKQGEFIIITGIIGSGKSSLLNALAGFMDKEEGELKINGSLLLCGYPWIQNAPVKENILFDSEYDEKKYKDTIYACSLDADLDILPAGDRTEIGERGITLSGGQKARINLARAVYAVNDIILLDDVLSAVDARVGKHIMDNCFMGLLKDKTRILATHQLSMINSADRVIFLNGDGTVDIGTPDELLKSNAAFLNLMEFSNDEKNTEEEQKEMNDEEDKELKRQMTEKSLLNDNDEDDEESRKDFTSKTGEAQLIQKEERAINGISFSIYKNYVMAGSGALKAGMTPVFFFFVILATFFQLFTNTWLSFWTEEKFPGRSSGFYIGLYVAFTCLTIIFVSTEFSLIVFITNKASKLLNIAAVTNLLHAPMSFFDTTPIGRILNRFTKDTDALDNEISQQLRLFIYPTANVCGVLILCIIYLPWFAIAVPFLVALFIGFANFYQASSREIKRLEALARSFVYNNFNETLGGMTTIKSFKAESRFLIKNNLYINRMNEAYFISLSNQRWLGIHLDLVASAFALIIALLSVTRQFQISAASVGLLVSYVMQIAGQLSLLIRAMTQVENEMNSVERLDYYAFHLPSEAPFDIPETAPPPTWPQHGVVEFKNVSLAYRPGLPLVLNNISFSVKAGEKIGICGRTGAGKSSIMTALYRLAELANGEINIDGINIAKIGLNSLRSKLSIIPQDPVLFRGNIRKNLDPFNKHNDDELWGALRRSGLIEESELSKVKCQALTDPQLHKFHLDQVVEDDGSNFSLGEKQLIALARAVVRNSKILILDEATSSVDYETDAKIQKTIVQEFSSCTILCIAHRLKTIVDYDRILVLDKGQVQQFNTPWVLFNKEGIFQKMCERSKITALDFNRKS

SEQ ID NO: 42 - protein, 1471 aa, Colletotrichum higginsianum
MADKGEKTNITASDPLAAAVEPITPRDPEDTTFAIEIDETDGNDGGSDSDEKRVRPELRSTKSHATDTSVATTAATRRQPQSKPWYKTPNPLKWGGIPPVPEERIVSREHRAGFFSLLTFQWMAPLMSAGYKRQLEPTDIWTVNPDRAADVMTDKLKAAFKKRVDRGDKYPLLWALHETYLFEFWLGGMLQLMSTVFQVMSPFTLRYLIQFANDAWDASQQGSPPPAIGRGIGLVLGVTFMQIFQSLGTNHFIYRGMMIGGQSRAVLISVIFEKAMSLSGRAKAGGIKEPAGSPPVDEKGKKKDNKGKGKKGEATKGPGISGDGTGWGNGRIVNLMSVDTYRIDQASALFHLTWTAPISCIITLVVLVINLSYSALAGFALLVAGIPLLTRAIRSLFKRRKAINKVTDQRVGLTQEILQSVRFVKYFGWESAFLERLKGIRRREIHAIQILLAIRNAINAVSLSLPIFASMLSFVTYAKTNNALNPALVFSSLALFNGLRIPLNLLPLVLGQVVDAWSSLKRIQDFLLAEEQEEDVVLKLDGENALEMTNASFTWERTTTQESEKSAAGTGKGGKKGTTQPLVASKPATKSEEPLASSGDSTGDGASTLVGEEREPFKLQDLNFEIKRDELVAVIGTVGSGKTSLLAALAGDMRKTSGEVVLGASRAFCPQYAWIQNATVRDNILFGKDMDKAWYQEVINACALRPDLAMLPNGDLTEIGERGITISGGQKQRLNIARAIYFDSDIVLMDDPLSAVDAHVGRHIFDNAILGLLKGKCRILATHQLWVLNRCDRVIWMEGGKIQAVDTFDNLMRDHRGFQQLLETTSQEEEKDETAPVNLTEAPQGDKKKNKKGAALMQQEERAVASVPWKVYGDYIRASGSMLNAPFLIFLLLLSQGANIMTSLWLSYWTSRRYPLSDGQYIGIYAGLGALQAVLMFVFSLLLSILGTKSSKVMLRQAVTRVLRAPMSFFDTTPLGRITNRFSRDVDVMDNNLTDAMRMYFFTLAMILSVFALIIAFFHYFAIALGPLFVFFILASSYYRASAREVKRFESVLRSTVFAKFGEGLSGVASIRAYGLKAHFIGDLRKAIDEMNAAYYLTFSNQRWLSTRLDLIGNLLVFTVGILVVTSRFSVPPSIGGLVLSYILGIVQMIQFTVRQLAEVENGMNAVERIQYYGTQLEEEAPLHTIEVRPSWPEKGEIVFDNVEMRYRANLPLVLSGLSMHVRGGERIGIVGRTGAGKSSIMSTLFRLVELSGGHITIDGVDISTIGLHDLRSRLAIIPQDPTLFKGTVRSNLDPFGEHTDLELWSALRQADLVPADANLEDPRSKESSVIHLDSIVEEDGLNFSLGQRQLMALARALVRGSRIIVCDEATSSVDMETDDKIQNTIATSFRGRTLLCIAHRLRTIIGYDRICVMDAGRIAELDTPLALWQQEGGIFRSMCDRSGIRLEDVRMASEGMALEVQVGQSSQGGL

SEQ ID NO: 43 - protein, 1560 aa, Candida auris
MSNHDYYRDLYGPRSDRNPYEAPHNDNFVATPSYHYYVQQQQRHQGNPAGTTHLHPTISDHSDTTTTYVEYQSDDSLADEPSMQQQQQRQHEKKKAKKKKVPRVPRFRRDKRAGAGAGAGAGSGSGQGDLENGKAELVNEKRLFSFLFSKKVDPVPLPDERKPYPWKLTNWANRAVFYWIWPILIRGYKRTLQPDDLWYLTDELTVEHLHREYRKNLKKILDKSKNKHIEKKGGGEGSDDDWEWPFYAVPLALFNTFRFQYTMSCIFLALSFVCQATSPLITRRLIDFVEYRYFGIETTYNKGIGYTIGAVILIFVNGLLLNHFFHNAMVAGAACKAILTKDVLIKSFKLSAKAKHRFTTGRITSLMSTDLSRIDLAIGFQPLVVCFPIPVVIAVVLLLTNIGVTSLVGIGLFVVSLVVCVLLTSKLFFTRETVVKYTDKRISLMREVLNNLKIIKFYAWELAYKANITKVRNQEMKYLFTIKVLRNFITAYAVTLPTLTSMISFVTMWKTGNMRDAGRVFSSLSLFSILAQAIMLLPIALATGADAMIGFRRCKDFLSATEYDSDLDRKLKQEEDEYVIGSDESVSGFEFKGNHKDNDSFNSDTYYGTEQEKISSLPPNVDIQISHADFVWDQYQGEEDDDSDSLWEPVSKKSDGINEKTANVKMSSESHSKDAKNSSFPGLLDINLTINSGEFVVITGVIGSGKTSLLNAIAGFMKMTNPGVGSVTISKDLLLCSQPWIQNATVRQNILFGSPMDRNRYKAILKACCLEDDLKELTHGDQTEIGERGITLSGGQKARINLARAVYRGGDTMLFDDVLSAVDARVGKRITDELFFGFLKNTTRVLATHQLSLVASADKIVFLNGDGTIDVGTTEELKARNPGFGKLIEFSKEDASGAPREETIQSNDNVCLLPSGVGVENEEDVKLAVTSSILPENGAAGDIVGRTVEDEDKAVNAISWTVYKNYINLGAGIFGYTAAPVFLFLVAIATFCQLFTNTWLSFWMEKRFKQLSDHFYVGFYVAFAFLTVFFTGIQFTMLAYMNNRSAELLNVKAVEKILHCPMSFMDTNPLGRVLNRFTKDTDSLDNEIGEQLRLFIFPLAMIIGIIILCICYLPWFAIAVPFLGCAFFFLADIYSGSSREIKRLEAVQRSVVYNNFNEILTGMHTIKAYKEEVNFIKKNDSLLNRMNEAYYLSIANQRWLCVHLDTIAALFALIISMLCITEQFNISPQSTGLLLNYVIQIVGLLSLTVRAMTQVENEMNSVERLHQYAFDLPQEAAYEKSETKPPPHWPPYGYVQFNNVNLRYRENLPLVLKDLTFGAYPDEKVGICGRTGAGKSSIMTALYRLSELESGSITIDNLDISQMGLRDLRSKLSIIPQDPVLFQGTVRRNLDPFDQYTDDVLWDSLRRSGLISEEQLERVKQTGLVDNNYDQLHKFHLDQNVEDDGGNFSLGEKQLLALARALVRGSKILILDEATSSVDYETDAKIQETIIREFKKCTILCIAHRLKTILTYDRILVMDQGRIVEKGTPWTLYRKNGLFRKMCDKARIVPEDFPPPPNDY

SEQ ID NO: 44 - protein, 1458 aa, Glomerella cingulata
MADKEEKTNITAPDPQAAAVEPITPKEPEDAAYVIDIDGTDEKNESSDVDEKTARPELKATKSHATDTSVATTTANRQPESKPWYKTPNPLRWGGVPPVPEERIVSREYKAGFFSQLTFQWMAPLMSTGYKRQLEPNDIWTVNPDRAADVMTDKLKAAFQKRVDRGDKYPLLWALHETYFFEFWLGGFLQLMSTIFQVMSPFTLRYLIQFANDAWDAANQGQPPPAIGKGIGLVLGVTVMQILQSLGTNHFIYRGMMIGGQSRAVLISAIFEKSMSLSGRAKAGGLKEGAKSQTDDKGKKKETKGKKGDAKGPAISGDGTGWGNGRIVNLMSVDTYRIDQACALFHLTWTAPISCVITLVVLCINLSYSALAGFALLVAGIPLLTRSIRSLFKRRKAINKTTDQRVSLTQEILQSVRFVKYFGWESAFLERLKEIRSREIHAIQILLAIRNAINAVSLSLPIFASMLSFITYAKTNNALNPAEVFSSLALFNGLRIPLNLLPLVLGQVVDAWSSLKRIQEFLLAEEQEEEVVYKPEGENALEMHNGGFTWERTPTQESEKTVGGKGGKKAPAQPAAAKKTEEPVTSSGDSTGDGASTLVEEEREPFKLQDLNFEIKRDELVAVIGSVGSGKTSLLAALAGDMRKTSGEVVLGASRAFCPQYAWIQNASVRDNILFGKDMDKAWYQEVINACALRPDMAMLPNGDLTEIGERGITISGGQKQRLNIARAIYFDSDVVLMDDPLSAVDAHVGRHIFDNAILGLLKGKCRVLATHQLWVLNRCDRVIWMEGGKIQAIDTFDNLMRDHRGFQQLLETTAVEEKEDDAPPTNLTEAPAVDKKKNKKGAALMQQEERAVSSVPWKVYTDYIRASGSILNAPFLIFLLLLSQGANLMTSLWLSYWTSKKYPLSDAQYIGVYAGLGAVQALLMFIFSLLLSILGTNSSRVMLRQAVTRVLRAPMSFFDTTPLGRITNRFSRDVDVMDNNLTDAMRMYFFTLAMIISVFALIIAFFHYFAIALGPLFVFFILAASYYRASAREVKRFESVLRSTVFAKFGEGLSGVASIRAYGLKSHFIADLRKSIDEMNAAYYLTFSNQRWLSTRLDLIGNLLVFTVGILVVTSRFSVPPSIGGLVLSYILGIVQMIQFTVRQLAEVENGMNAVERIQYYGTQLEEEAPLHTIEVRPSWPEKGEIVFDNVEMRYRANLPLVLSGLSIHVRGGERIGIVGRTGAGKSSIMSTLFRLVELSGGHITIDGVDISTIGLHDLRSRLAIIPQDPTLFRGTVRSNLDPFSEHTDLELWSALRQADLVPAGANLGDPRSKDPSRIHLDSVVEEDGLNFSLGQRQLMALARALVRGSRIIVCDEATSSVDMETDDKIQNTIATSFRGRTLLCIAHRLRTIIGYDRICVMDAGRIAELDTPLALWQREGGIFRGMCDRSGIRLEDIRGASEEMGSKDQAGESSQI

SEQ ID NO: 45 - protein, 1377 aa, Unknown
  ABC Transporter Polypeptide
MKSDNIAMEDLPDSKYLKQRRLLTPLMSKKVPPIPSEDERKAYGEYYTNPVSRMMFWWLNPILKVGYRRTLTENDLFYLEDRQRTETLYEIFRGYLDEEIARAWKKSQESSDDPREFKLPIYIIPLCLFKTMKWEYSRGILQKILGDCASATTPLLQKKLINFVQVKTFSNVGNTGQGVGYAIGVCLMIFFQVLMLTHAFHNFQISGAKAKAVLTRLLLDKSLTVDARGNHYFPASKIQSMISTDLNRIDLAVGFAPVGFVTIFPIIICIALLIWNVGVSALVGIGVFIANIFVLGLFVSSLMLYREKAMVFTDKRVNLVKELLKNFKMIKFYSWENSYQDRIENARNNEMKYILRLQLLRNFVFSLAFAMPVLASMATFCTAFKITDGKSAASVFSSLSLFEVLSLQFILAPFSLNSTVDMMVSVKKINQFLQHKDTNPNEFSVEKFSDSTLAIKVDNASFEWDTFEDEEKDYEEEAKTKDNIEDEDHNCATETIKGKITVDYKSDSDSISSTLTKGVKTAFPGLNNINLEIAKGEFIVVTGAIGSGKSSLLQAISGLMKRTSGEVYVDGDLLLCGYPWVQNSTIRENILFGLPFNKERYDQVVYSCSLQSDFDQFQGGDMTEVGERGITLSGGQKARINLARSVYADKDIILLDDVLSAVDAKVGKHIVNTCILGLLGGKTRIMATHQLSLIDSADRMVFLNGDGTIDFGTIPELRKRNQKLIELLQHQRDPGQDKEDLSNDLDIQGSTDEGQQIEHADEHKEIVKIIGDEEKAVNALSFQVYYNYCKLAFGKLGYISMLVFIIVSSLETFTQIFTNTWLSFWIEDKFVSRSKNFYMGIYIMFAFLYAIMLCFFLFLLGYFCVKAAERLNIKASRKILHVPMSFMDISPIGRVLNRFTKDTDVLDNELLEQLIQFLSPLFNCFGIIILCIVYIPWFAIGVPIILGFYFIIASYYQASAREIKRLEAVKRSFVFGHFHEVLTGKDTIKAYNAIDRMKLKLNKLIDEQNEAYYLTIANQRWLGANLAIVSFSMVFVISFLCIFRVFNISAASTGLLLTYVIALTDSITMIMRAMTQVENEFNSVERVNHYAFDLIQEAPYEIPENDPAEDWPQHGKIEFKDVSMRYRPELPFVLKNINLSVREQEKIGFCGRTGAGKSTFMTCLYRITEYEGLISIDGVDISRLGLHRLRSKLTIIPQDPVLFVGTIRENLDPFTEHSDDELWEALAISGLIEREDLEVVKGQEKIGGNDSGKLHKFHLVRMVEDDGINFSLGERQLIALARALVRKSKILILDEATSSVDYATDSKIQRTIASEFRDCTILCIAHRLNTILGYDKIVVMDNGEIVEFENPKLLFMRENSVFRSMCEQANITINDFE

SEQ ID NO: 46 - protein, 1380 aa, Wickerhamomyes anomalus
MPFFKRKISQETFKSNKEKAQVDSSTVTDIESNANEVLKNPTLKKTSPVIRTIIGKTPAPIEQNHETYPFLKANFFQALTFTWVAPLIKKGYLRRIEDEDLYQLDGDLKVREMTEKFEQSLAKRVEEWKRKNPDKEKYTKIVVIKAINDTFKTRYWKGGVSKVFADLSQILNPLLVRTLIKYIQHKGDNKVVPQTGHSVGTAIGISVMLIFSSLMISSFFHLSMLTGAQCKALLTNVIYRKAFKLSAKARLDFPNGKVNSLVMADLSRIDLAVGTFHFVWAFPISFIVALIVLVVYLGAPALLGLALILILLGFMMYATRKLKNLRRQSTVYIDKRVRSINEIINTLKMIKFYCWEKPYYETVEKFRLNEKRFILKMQLLKAILNSGVSSVAVLATMVVFLTMQKTSTNFQSYNIFSAVTLFNTLRFPLNVLPMAVGFLVDALLAMDRVAEFLQAEEGEDTVERYEYDESDNAIVIENGCFKWDVEEDEDFKLKAQMTRQSMKPHQTNEDEEGEDLSFPGLLNIDLTVKKNELVIVTGSIGTGKTSLLNAIEGSMRKESGDSKIYGSLTFCSYPWIQNETIKENILFGLPFIRSKYESIVKACALDVDFDVLPDGDQTEVGERGITLSGGQKARINLARAVYADRDIILLDDVLSAVDARVGKHIMNECICGLLKDKTRLLATHQLSLIGAADRIIVLDGSGSIDIGTYNELMASNSAFAKLMEFNKEQEDEEEEEEQLEEQEEMELERQKTQISRIQSEKQEDEDARKEKGRITVAEDRGTQNISFGIYANYMILGSGKLGVAIVPLFLLIVVLNGFFQLFYSVWLSFWISHKFDISDSTYKGLYIMFCFLATFSFVTLFSAMAALNNKAGLHLFNLSAQKLLKTPMWFMDVTPIGRIMNRFTKDVDVLDTDMIEQLRLFVQSVSLVGGVVILCGVYIPWFFLVLPFVFTLYYYLAHYYKTSALDIKRLESVKRSFVFSHFNESLSGMKVIKSYSSSERFKDKYESLIDSMDAAYFLTLANQRWLSIRLDCISSLVSFFVAMLCIFGVFNMDGASSGLLVSYIIQIASMMSLLLRSMTQLENDMNSVERLFEYAKKLPEEGPFELEDNKPDESWPEQGGIEFDDVCLSYREGLPLVLKNVSFKVNPSEKIGIVGRTGAGKSTIMNALFRVTELAQGRVIIDGVDISKIGLNDLRSKLSIIPQDPVLFHGTIRQNLDPFGASSDFDLWDALKRSWLVEDGAAGTGQFVAGKSDIKTLHKFHLDQKVEDDGANFSLGERQLLALARALVRNTRVLILDEATSSVDYETDSKIQSTIINEFRQCSILCIAHRLKTILNYDRILVLDKGEVKEFDTPLNLFKLGGIFTEMCERSNITETDFGA

SEQ ID NO: 47 - protein, 1421 aa, Wickerhamomyces ciferrii; identical to SEQ ID NO: 15

SEQ ID NO: 48 - protein, 1381 aa, Kuraishia capsulate
MSEPPRQKRILSWALSKKVPPITQEEDRLEYPFKRANILSKIFFSWLDPLLHKGYRRTLEPEDLWYLTDELKLEHYYSVFLAQFEPDLAARREAHLEAKCKARGETFETSTVTEDEDLADFVYPWPKFGLILLKTFFRQYVGACVLKTIGDLASTTAPLLQKALINYVTKRAKGLEPNVGTGVGYAIGCALFVTLEGLMVNHYFYHAMVTGSQVKAILTKFMLEKSFRQTGRSRHDFPTGKVNSIMGTDLARIDFAIGFLPFLFCFPVPAIVSIVLLIINIGPSSLVGIAIFFLALIALGSTIKRLMFFRLRANKFTDGRVNLVKELLKNFKMIKYYSWEPSYVKNIEETRTAEMHNVFLMQIMRNIMVAFAIALPTVCSMISFLVLYGINSSRSVADIFSSLTLFQVLAMQLIMVPLALASGSDALIGIRRVLEFVCSGDIDEEDSQVELSLIKEKMESSGSVLRVVNASFEWETFDADEEDIASTNESVSENERKPDPSLEGLESTSFPGLNNINLDIRKGEFVVVTGLIGSGKSSLLYALSGFMHRTQGHVATIGDLLLCGNPWIQNATVKDNISFGMPFDQQKYDNVIHACSLEADLDLLPAGDHTEVGERGITLSGGQKARLNLARAVYADRDIILLDDILSAVDARVGKHIMDECLLGLLKDKTRLLATHQLSLISAADRVIFLNGDGSIDVGTTAELLARNEGFTKLMEFSTQEKNDTTTESGEAAHSGPELEDEKELIRIQTLTKSLAEAESNSDYQHKDADGVLMQLEDRAVNAIELGVYGKYLKLGAGAFGIGIIPLLLGLVACSVFCSLFTNTWLTFWTEKKFDRSNGFFIGIYVMFTMLTIVFMVLEFSLLVYLTNTASRLLNIYAIRRLMHVPMSFMDTTPMGRILNRFTKDTDVLDNELPEQIRLLVHFTGTITGILVLCIIYLPWFAISVPILAFCYIACASYYQASAREVKRIEALQRSFVYSNFNETLQGMEVITAYKAEKRFIARNDALIDKMNEAYYLTFANMRWLSIRIDVLAAVLVLIVSLLCVMRVFHISPASVGLLLSYTLNIAGMMSMLLNVSTQIENEMNSVERLEYYGFRVVQEAPFKISEKTPPPEWPHDGRIQFENVTLCYRQGLPAVLKNLNMDVKGAEKIGICGRTGAGKSSIMTALYRLAEMESGGRILIDDIDISTLGLHDLRSRLSIIPQDPVLFRGSIRGNLDPFHEHKDELLWDALRRSGLIEGSKLDQVKHQTLDDENLHKFHLGQNVEDDGTNFSLGERQLLALARALVRNSKILILDEATSSVDYETDSKIQTTISTEFAGCTIMCIAHRLKTIVNYDRILVLDKGEISEFDKPWALFQDESTIFRQMCNKSGVVAEDFEKQN

SEQ ID NO: 49 - protein, 1381 aa, Saccharomyces cerevisiae; identical to SEQ ID NO: 22

SEQ ID NO: 50 - protein, 1381 aa, Cyberlindnera jadinii; identical to SEQ ID NO: 5

SEQ ID NO: 51 - protein, 1404 aa, Cryptococcus albidus
MSQSDQLPDQLEVENQPIIKNEKRLLSWMLSKKVPSVPSQDERTLYPLHRTNIISRIMFWWLFPVLNKGYKRTLVAEDLWIVDKDLTIEDMSTKFYNNLNRRIDAAKLKFENKPNKEDDEKFQWPKLIIVSSLFETFKVQYLLAILYLALSSVVQSLTPLLTKKLISFVEGRVLGTETTSNKGIGYSFGAFCLVFLNGLFTNHFFHNSMLTGAQIKSVLTKSLLDKSFRLNAKAKHDFPTGKITSLMGTDLARIDLAIGFQPFICCFPISMIISIALLIHNIGVSALAGIGVFVISILLITASTKALFKIRKSVNFFTDKRVGLMREVLTSIKVIKFYAWEDAYKDNIADVREKEMASLFKIKIIRNFITAFAISLPTLTSMVAFCVMYAVKRGQNPADIFSSVSLFSVLSQAIFLVPVALATGADAYAGLDRVRLYLSSGEESSDDDLSMTETASTEEEKETEIAIKVSHASFKWEQFYDNEEENEKTANDKNEGTESKAAKKARKLAKDKKKEQMKEITKTKSHISNQLPAIESESFAGLTDLDFTIEKNEFIIITGLIGSGKSSLLSALAGFMPRQSGFVESNGSILLCGYPWVQNATVKENILFGQPFDEEKYKSVIYACALEADLDILPAGDRTEIGERGITLSGGQKARINLARAVYNDQDIILMDDVLSAVDARVGKHIMDHCFMGLLKEKTRILATHQLSLIGSADRIIFLNGDGSMNMGTAEELAGSSSNFLKLMEFNSKSNDDEEESDGDVEDEILKDSKIVTVNEEEIRTKYGDKTKSGILMTTEEKAVNSIPWSIYKTYINLGSGFFKFSATPIFLLLVILSTFCQLFTNVWLSFWTEKKFHGYSDGFYIGLYIMFTFLTVFFLTGFFSMLAYTTNKAAERLNLMAVQKMVHAPMGFMDTTPMGRILNRFTKDTDSLDNEIAEQLRLLFYPLSTIIGVIILCIIYLPWFAIAVPFLVGLFIVISNYYQASSREVKRLEAIQRSFVYNNFNEVLNGMSTIKAYSAQQFFIQKSDGLINRMNEAYFITIANQRWISIHLDLIASIFALIIALLCVTRTFSISAASTGVLLSYVLQIVGLMSLFIRALTQVENEMNSVERLCHYAQDLPQEAPYRINERQPSPEWPMNGELEFEDVSLSYRPGLPLVLKDLTFGIKAGEKIGICGRTGAGKSSIMTALYRLSELTKGKIIIDGIDISTLGLYDLRSKLSIIPQDPVLFQGTVRKNLDPFSEHSDDSLWDTLRRSGLIEESQLAQVSRSTKNENNTYEDLHKFHLDQLVEDEGANFSLGERQLLALARALVRNSKILILDEATSSVDYETDSKIQSTIVNEFSHCTILCIAHRLKTILNYDRILVLDKGEIEELDTPINLFNKKDGIFRQMCERSNIMEQDFGSSF

SEQ ID NO: 52 - protein, 1422 aa, Candida haemulonii; identical to SEQ ID NO: 6

SEQ ID NO: 53 - protein, 1517 aa, Debaryomyces fabryi; identical to SEQ ID NO: 25

SEQ ID NO: 54 - protein, 1426 aa, Spathaspora passalidarum
MSEDPHFLQQKRLLTFMLSKKVPPIPTEEERDPYPVKKANIISRILFWWLGPVMHTGYRRTLQPEDLFYLTDDIKVQTMADRFYNYMTNDIERARQQHIAEKCKERGETPETSSVDRGKDLADFELSKFLTVWALAKTYKWQYTWACTLLCLSSVGQTTLPLLTKKLIRYVELKSMGVETGIGRGIGYSFGSAIIIFIIGVLINHFFYRSMLTGAQAKAVLTKALLDKSFKLNAAARHKYPVGKITSMLGTDLSRIDFALGFQPFLICFPVPIGIAIGILIWNIGVAALVGVAILLVFMVCIAVSTGALFKYRKKANKYTDSRVDHIKEALNNLKIIKFYSWEPPYHENISEIRKKEMKIIYRMQVLRNVVTSFAFSLTLFASMTAFLVLYAIAANRKDPASIFSSLSLYNILTQQVFLLPMALATGADAFMGISRVGEFMSQGEIDPALSNIDATPEKKLLMENDETAIEVDHASFEWEVFGNDEDDEEESESKKGEKKSMEKKVHKTEVHYHEKTGSIEKDSLTTSSSGRGEEESQFPGLKDINFKIKKGEFVVITGLIGSGKTSLLNAISGFMKRVHGDVSTNGSLLLCGYPWVQNSTVKENILFGEPYDEKKYKQVIYACSLEADLEILPAGDRTEIGERGITLSGGQKARINLARAVYANRDIILLDDVLSAVDARVGKHIMNNCIMDLLKDKTRILATHQLSLIGSADRVIFLNGDGSVDVGTFEELSSSNPGFSKLMTFNSEAHNDEEEEEDVPESEDELEQEREMIKRQLTRLSTRASTKADPEDEEARHREFNTDESADGKLIDEEERAVNAISMRVYGRYIELGSGAVGPYVYGPLLLIFLMFATFCSIFTNTWLSFWVERRFPLEDKVYIGVYIMFTFLAFIFLTIEFILLVYLTNTASVKLNILAMKKVLHAPMSFMDTTPLGRILNRFTKDTDVLDNEIGDQLRFFLFTLSNIIGVLILCIIYLPWFAISIPFLGFLFVAIANYYQASAREIKRLEAIQRSFVYNNFNETLSGMTTIKAYHAVPRFLEKNNFLIDRMNEAYYLTIANQRWLAIHMDMVASLFALLIALLCVNRVFRISAASVGLIVAYVFQIAGQLSMLIRTFTQVENEMNSVERLDSYASNLPEEAPYVITEKTPPPQWPDKGSIEFRSASLAYRPGLPLVLKNLNFTIKPSEKIGICGRTGAGKSSIMTALYRLSELESGKIFIDDLDIAELGLKDLRSKLSIIPQDPVLFRGTIRKNLDPFNQSSDDKLWDALRRTGLIEEGRLEQVKLTNKPSDGSSETNLHKFHLDQSVEDEGTNFSLGERQLIAFARALVRDSKILILDEATSSVDYETDSKIQHTIIREFSHCTILCIAHRLKTIINYDRILVLDKGEIREFDTPWNLFKSNGSIFQQMCQRSNITDQDFENITSF

SEQ ID NO: 55 - protein, 1620 aa, Hansenula polymorpha
MSLELSNSTLCDSYWAVDDFTACGRQLVESWVSVPLVLSALVVAFNLLRNSLASEKTDPYSKLDAEQQPLLQNGHALYTSSIESDNTDIFQRHFDIALLKPVKDDGKPIGVVRIVYRDTAEKLKVALEEILLISQTVLAFLALSRLEDISESRFLLVKYINFSLWLYLTVITSARLLNVTKGFSANRVDLWYHCAILYNLQWFNSVMLFRSALLHHVSGTYGYWFYVTQFVINTLLCLTNGLEKLSDKPAIVYEEEGVIPSPETTSSLIDIMTYGYLDKMVFSSYWKPITMEEVWGLRYDDYSHDVLIRFHKLKSSIRFTLRLFLQFKKELALQTLCTCIEALLIFVPPLCLKKILEYIESPHTKSRSMAWFYVLIMFGSGVIACSFSGRGLFLGRRICTRMRSILIGEIYSKALRRRLGSTDKEKTTEEEDDKSAKSKKEDEPSNKELGGIINLMAVDAFKVSEIGGYLHYFPNSFVMAAVAIYMLYKLLGWSSLIGTATLIAILPINYMLVEKLSKYQKQMLLVTDKRIQKTNEAFQNIRIIKYFAWEDKFADTIMKIREEELGYLVGRCVVWALLIFLWLVVPTIVTLITFYAYTVIQGNPLTSPIAFTALSLFTLLRGPLDALADMLSMVMQCKVSLDRVEDFLNEPETTKYQQLSAPRGPNSPLIGFENATFYWSKNSKAEFALKDLNIDFKVGKLNVVIGPTGSGKSSLLLALLGEMDLDKGNVFLPGAIPRDDLTPNPVTGLMESVAYCSQTAWLLNATVKDNIIFASPFNQERYDAVIHACGLTRDLSILEAGDETEIGEKGITLSGGQKQRVSLARALYSSASYLLLDDCLSAVDSHTAVHIYDYCINGELMKGRTCILVSHNVSLTVKEADFVVMMDNGRIKAQGSVDELMQEGLLNEEVVKSVMQSRSASTANLAALDDNSPISSEAIAEGLAKKTQKPEQSKKSKLIEDETKSDGSVKPEIYYAYFRYFGNPALWIMIAFLFIGSQSVNVYQSYWLRRWSAIEDKRDLSAFSNSNDMTLFLFPTFHSINWHRPLVNYALQPFGLAVEERSTMYYITIYTLIGLAFATLGSSRVILTFIGGLNVSRKIFKDLLDKLLHAKLRFFDQTPIGRIMNRFSKDIEAIDQELALYAEEFVTYLISCLSTLVVVCAVTPAFLVAGVLILLVYYGVGVLYLELSRDLKRFESITKSPIHQHFSETLVGMTTIRAYGDERRFLKQNFEKIDVNNRPFWYVWVNNRWLAYRSDMIGAFIIFFAAAFAVAYSDKIDAGLAGISLSFSVSFRYTAVWVVRMYAYVEMSMNSVERVQEYIEQTPQEPPKYLPQDPVNSWPSNGVIDVQNICIRYSPELPRVIDNVSFHVNAGEKIGVVGRTGAGKSTIITSFFRFVDLESGSIKIDGLDISKIGLKPLRKGLTIIPQDPTLFSGTIRSNLDIFGEYGDLQMFEALRRVNLISVDDYQRIVDGNGAAVADETAQARGDNVNKFLDLDSTVSEGGGNLSQGERQLLCLARSILKMPKILMLDEATASIDYESDAKIQATIREEFSSSTVLTIAHRLKTIIDYDKILLLDHGKVKEYDHPYKLITNKKSDFRKMCQDTGEFDDLVNLAKQAYRK

SEQ ID NO: 56 - protein, 1650 aa, Kluyveromyces lactis
MSGSNSNSNLDAISDSCPFWRYDDITECGRVQYINYYLPITLVGVSLLYLFKNAIQHYYRKPQEIKPSVASELLGSNLTDLPNENKPLLSESTQALYTNPDSNKTGFSLKEEHFSINKVTLTEIHSNKHDAVKIVRRNWLEKLRVFLEWVLCALQLCIYISVWSKYTNTQEDFPMHASISGLMLWSLLLLVVSLRLANINQNISWINSGPGNLWALSFACYLSLFCGSVLPLRSIYIGHITDEIASTFYKLQFYLSLTLFLLLFTSQAGNRFAIIYKSTPDITPSPEPIVSIASYITWAWVDKFLWKAHQNYIEMKDVWGLMVEDYSILVIKRFNHFVQNKTKSRTFSFNLIHFFMKFIAIQGAWATISSVISFVPTMLLRRILEYVEDQSTAPLNLAWMYIFLMFLARILTAICAAQALFLGRRVCIRMKAIIISEIYSKALRRKISPNSTKEPTDVVDPQELNDKQHVDGDEESATTANLGAIINLMAVDAFKVSEICAYLHSFIEAIIMTIVALFLLYRLIGWSALVGSAMIICFLPLNFKLASLLGTLQKKSLAITDKRIQKLNEAFQAIRIIKFFSWEENFEKDIQNTRDEELNMLLKRSIVWALSSLVWFITPSIVTSASFAVYIYVQGQTLTTPVAFTALSLFALLRNPLDMLSDMLSFVIQSKVSLDRVQEFLNEEETKKYEQLTVSRNKLGLQNATFTWDKNNQDFKLKNLTIDFKIGKLNVIVGPTGSGKTSLLMGLLGEMELLNGKVFVPSLNPREELVVEADGMTNSIAYCSQAAWLLNDTVRNNILFNAPYNENRYNAVISACGLKRDFEILSAGDQTEIGEKGITLSGGQKQRVSLARSLYSSSRHLLLDDCLSAVDSHTALWIYENCITGPLMEGRTCVLVSHNVALTLKNADWVIIMENGRVKEQGEPVELLQKGSLGDDSMVKSSILSRTASSVNISETNSKISSGPKAPAESDNANEESTTCGDRSKSSGKLIAEETKSNGVVSLDVYKWYAVFFGGWKMISFLCFIFLFAQMISISQAWWLRAWASNNTLKVFSNLGLQTMRPFALSLQGKEASPVTLSAVFPNGSLTTATEPNHSNAYYLSIYLGIGVFQALCSSSKAIINFVAGIRASRKIFNLLLKNVLYAKLRFFDSTPIGRIMNRFSKDIESIDQELTPYMEGAFGSLIQCVSTIIVIAYITPQFLIVAAIVMLLFYFVAYFYMSGARELKRLESMSRSPIHQHFSETLVGITTIRAFSDERRFLVDNMKKIDDNNRPFFYLWVCNRWLSYRIELIGALIVLAAGSFILLNIKSIDSGLAGISLGFAIQFTDGALWVVRLYSNVEMNMNSVERLKEYTTIEQEPSNVGALVPPCEWPQNGKIEVKDLSLRYAAGLPKVIKNVTFTVDSKCKVGIVGRTGAGKSTIITALFRFLDPETGYIKIDDVDITTIGLKRLRQSITIIPQDPTLFTGTLKTNLDPYNEYSEAEIFEALKRVNLVSSEELGNPSTSDSTSVHSANMNKFLDLENEVSEGGSNLSQGQRQLICLARSLLRCPKVILLDEATASIDYNSDSKIQATIREEFSNSTILTIAHRLRSIIDYDKILVMDAGEVKEYDHPYSLLLNRDSIFYHMCEDSGELEVLIQLAKESFVKKLNAN

SEQ ID NO: 57 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 58 - protein, 1530 aa, Hansenula polymorpha
MSEYHINGHFYEPSAIYDLQRVSTFWEQLVMDLTSSGFNNAIGLNNSTGSRCGCYDGEGYKFSSDLQDPSPCLVSGVFASLVSLVFVIGGLVQVHKLRKTRNVNSKVEWWFVLKLSLIAVQIVFQLTLATLAVRMSPSPLSDVLVLSSGLNFIALGVAFALSYIENFKTFVSEAALIIYWLLYLFIGFLKIVNLGLRNDKSSRLPITVLSTVNNLILLVIEIYFAPKAPVDPTQTENLYDSANIFGKVTFTWLTPLMQKGSIKYLTQFDLPALPSFLKSDHLSGVLESHWAKQLRSKKPSLAIALAKSFGGPFLVAALFKVVQDCCAFIQPQLLKQLIRFVNEYHEDPTIPLTKGFMIVASMFILSVLQTASLHQYFTRVFDTGIKVKSSLTSLIYKKSLVLSIEAKQKKSSGDIVNLMSVDTQRLQDLCQNLNVIWSGPFQIILCLISLYNLLGNAMWLGVLFLCISVPMNTWVFGQQKKLQKTQMKVKDERTGLISEMLNNIKSLKLYAWEIPYKKKLMYVRNNKELSNLRKIGIFQACSQFIFNTTPYLVSTSTFALFIVAYKGVPLSTDIVFTALSLFNLLGFPLAVLPWTIGNIIEAQVAISRITGFLESDELDTSTVTRLPAPTEIGQDVVNIVNADFLWSKDPYKAALENINFTAKKGQLNCIIGRVGAGKTALLQSLLGDLHKPTGTVIVRGSVAYVPQTAWIMNGTIKENILFGCKYDPDFYDKTIKACALTHDLNVLTDGDATQVGEKGISLSGGQKARLSLARAVYARADLYLLDDILSAVDEHVGKHLINNVLGPDGLLSTKCRILATNNLNVLKFSDHISLLQNGKITESGHYDDIISAQKSELYNVINDSGAKKKDDEVSEDVSETVIDKESSEDTQSVSSELDEDIKKCASKDLPKAELEDFKAVVSRKNETLTGREEKHEQGKVKTAIYRAYAKACGVKNVIFFLVTVILSMGASVLANIWLKHWSDINTRLGYNPQPWKYLGTYFGLCVASTFFLLCQTLVQWLAVSIQGSKYLHQIMLDGVLRAPMQFFETTPIGRILNRFSPDIYKIDEQLARVFAMFFTNSIKVTFTMLVIIYSTWQFVFLVVPLAVLYRFYQLYYLATSRELRRLDSVSKSPIFAHFQETLSGVATVRAYDQLERFMYMNQQKMDVNMSAYHPSVSANRWLAVRLEFLGSLIILGASSLLVATLRSGRVTPGLVGLSISYALQTTQSLNWIVRMTVEIETNIVSVERVLEYAALEPEAPAIIENKRPPSHWPSKGTINFKNYSTRYRPDLDLVLKNINLAIKEKEKIGIVGRTGAGKSSLTLAIFRIIEAFEGHIEIDDLNTSEIGLFDLRSKLSIIPQDSQIFEGTLRANIDPIEQYSDDEIWQALELSHLKDHVMVMYEESTNKEDIKMDPLLVRINEGGSNLSAGQRQLMCLARALVKKESKVLILDEATANVDYQTDAIVQETIRSAFKERTILTIAHRLNTIIDSDRIIVLEKGEVAEFDTPQNLLKKKDSLFYSLCKEGGLVE

SEQ ID NO: 59 - protein, 1517 aa, Pichia pastoris
MNSLDFIADSVQHLFEQTSMNILPSSGLNSGSLQNESLPVTCSWGCFDEEGWGPMSPYSDLTTCFINGALINFSSLFLVLVGGYQLVALRRSRTTNTNIDWTLPLKLVLISFQIILNVNLAANYFYESVDFKHDIKFVTPVFSSVALIVALFAHYVEVFKTSVPLGSLLFYWLFTFVSGCFNLGNLIVRSNYANPTLVTTVFTIVIALILLILESAFPIRPASPAGYEIFYPLSPFDTAHVFSRITFQWMSGLMKKGHESFLGEDDLPPLPKYLTAKMTSEKFNYNWTHQLRTKKDQLSLTWALAKSFGAPFLVGGIFKACQDILAFTQPQLLRILIKFVNDYNDGNGTVPLTKGFMIVISMFLVSIVQTGCLHQYFQRAFDMGMKIKTALTSSIYSKSLTLSNEEKSKYATGDIVNLMSVDTQRLQDLVQNIQIIWSGPFQIILCLFSLHGLVGNSMWMGVVIMIIMIPLNGALAKYQKKLQKIQMKNKDQRTRIVSEILNNIKSLKLYGWESPYKERLTYVRNEKELKNLKKMGIFQAFSTFTWSCAPFLVSCSTFAVFVLTNKNSPLTTDIVFPALALFNLLSFPLAVIPMVITSIVEAQVAISRLTKFLTGSELQNDSVIRLPRSKKVGETVVRIKSGQFLWCREPYKVALKDVNFAARKGELSCIVGKVGAGKSSLIRSILGDLYKSEGTVIIRGSVAYVSQVPWIMNGSIKENILFGCKYEPEFYKKTLEACALDTDLSILTDGDATQVGEKGISLSGGQKARLSLARAVYARADVYLMDDVLSAVDEHVGKHITTHVLGPSGLLSSKCRILATNNINVLKHSSHVSLIQEGSIIEEGNYQTVVSNSSSKLSVLIKEFSKAASSTDNSGTNSTAEVTPVPSQLGISKSVSDTVSLRRASLESFSKSTSNNLDEESKQKINKEHHEQGQVKFNVYKVYANACNPKAVCFLLFLIILAMFTSVLGNIWLKHWSEVNTEYGGNPNIALYLGIYFALGIASSLLSLLKTAMQWIYCTISGSKYLHKTMTDSVFRAPMEFFETTPIGRILNRFSSDIYKVDEILGRVFEQFFTNAVKVFFTVAVICYSTWQFIFMILPILMLYVYYQQYYLRTSRELRRLDSVSRSPIFAHFQETLTGTSTIRAYNQLDRFRYMNQSKVDFNISAYHPAISANRWLAVRLEFLGSVIILGASGLSIFTLKSGGITAGMVGLSVSYALQITQSLNWIVRMTVEVETNIVSVERIIEYSTLKSEAPAIIEDNRPPKDWPFEGKIEFKNYSTRYREGLDLVLKDINVSINPKEKIGIVGRTGAGKSSLTLALFRIIEAAQGSIWIDGIDTSKIGLEDLRHKLSIIPQDSQVFAGTLRENLDPTNQYSDDEIWKAIELAHLKPLVISMAEGDATGLEVRLAEGGSNLSVGQRQLICLARALLIKSHILVLDEATAAVDVETDQVLQETIRKEFKDRTILTIAHRLNTIMDSDRIIVLDNGRIAEFDTPANLLKNKESLFYSLSSEGGTIE

SEQ ID NO: 60 - protein, 689 aa, Saccharomyces cerevisiae
MQAQGSQSNVGSLRSNCSDNSLPNNHVMMHCDESSGSPHSEHNDYSYEKTNLESTASNSREHRDNQLSRLKSEEYVVPKNQRRGLLPQLAIIPEFKDARDYPPMMKKMIVFLIAFSSMMGPMGTSIIFPAINSITTEFKTSVIMVNVSIGVYLLSLGVFPLWWSSLSELEGRRTTYITSFALLFAFNIGSALAPDINSFIALRMLCGAASASVQSVGAGTVADLYISEDRGKNLSYYYLGPLLAPLLSPIFGSLLVNRWPWRSTQWFMVILSGCNVILLTVLLPETLRKQDSKGAIAQILAERRIQVDNNERGEIQEDYQRGEDETDRIENQVATLSTEKHNYVGEVRDQDSLDLESHSSPNTYDGRAGETQLQRIYTEASRSLYEYQLDDSGIDATTAQVTRIRSTDPKLARSIRENSLRKLQTNLEEQVKKVLSSNGGEIAPKQVSAVRKVWDTFFVYFIKPLKSLHFLEYPPVALAITFSAISFSTVYFVNMTVEYKYSRPPYNFKPLYIGLLYIPNSVTYFFASIYGGRWVDMLLKRYKEKYGILAPEARISWNVVTSVISFPIALLIFGWCLDKKCHWVTPLIGTALFGYAAMMTIGATLSYLVDSLPGKGATGVALNNLIRQILAATAVFVTTPMLNGMGTGWAFTMLAFIVLGASSVLIILKKHGDYWRENYDLQKLYDKID

SEQ ID NO: 61 - protein, 1469 aa, Pichia pastoris
MERDTHEADPAQPVLSHNNSSGDEVLSYRAEDEQAQLEGVNLDRLQSLTKQMSHVTASEMATMVDLNDFDLTRILAVFAEKAEQRGLPIKSTAVELKDVSVLGVNDSASLLPTVSDLLYLPSTIARKIRNRKPALRHILKGVDFHTVPGEMCLVLGRPGAGCSSLLKTIAGETSHFVRVEGDIAYNNIPQAEMVKRFKNELIYNPELDLHFPHLTVEETLSFALACKTPRIRIDDISRKKHVDNWLKILLTVYGLGHTRNTIVGNDFVRGVSGGERKRVSIAEAMAANGTVYCWDNATRGLDASTALEFTESVRATTNLEQTTSFVTLYQPSERIYELFDKVLVLYEGRQIYFGPADAAKQFFVDMGYDCPPRQTTGEFLTAVTDPLQRYPRPGFENRVPINADEFQEYWRASSTYSDLQNQFQETLKAGLSETTKETFLKAAANEKMKGVSDNSKYTVNYFEQLRLCIVRGFQRIKGDINYTIVMVVSALIQGLVVGSLYWNTPENSSGVFGRAGVIFFAILFFVLMSLAEIANIFKDRPVLAKQIGYSLYHPSTEVIANALIQIPVKFIASLFFSIVVYFLANMKRQPGPFFAFLLFVNLGSQTMAALFNLVAAVSPTLAVANAFDGLLVLSSVLYTSYMIQRPSMVPWFEWFSYMNPMLYAFESMLTNEFHGSIIDCSDVDLIPNGPGYEDYPDQYRSCAITGANGRTYVDGDTYLDLSFEYSYSHIWRNMGILFLFYVAFLVIHSVMSEIMNMSTSTADRLIFLKANDLPVEVAAALNGSASSNDEETGQDTSLNEKYELERDKSEVKVSDKLLGSDEVFTWKDVNYVIPYQGSERTLLDHVQGYVKPGTLTALMGESGAGKTTLLNVLSQRIDVGVVTGDMLVNGNPVSASFKRRTGYVQQQDLHISELTVRESLIFAAKLRRPLSVPVAEKIQYVDQVIEILQMTKYKDAVAGELGAGLNVEQRKKLSIATELVSKPDLLLFLDEPTSGLDSQSSWAIVKLLRQLADAGQAILCTIHQPSATLFEQFDRLLLLRKGGQTVYFGDIGENSSVITGYFERNGARKCSPAENPAEYILEVIGAGATASITENWFDVWIKSPESQEVSQEISTLVTRAGNSTSSVDDAAHLGTFATPWHYQYQLVLQRTAQQFFRDMEYFMAKFMLLLSGGLLIGFSFWDVKHTIVGMQNAMFAVFSAMILSAPLSNQIQSKAIASRELYEARESKSNTFHWSALLLSQFLVEIPYSVVFSTIFYICWYFPVQLDNAPERAGVWWLHYCIFFQLYYISFALATVYFAPDLPTANVILSFLFNFIFAFCGVVQPVDMMPGFWTFMNKVSPYTYFVQSFLGNVLHGREVHCAANEMTYIQPPSEQSCGEYLTPFIEEHTGYVANPGAFEDCGFCKFAVGDQYLSTVGIKYSYGWRNVGFYWVYIVFNLSAMLFLYYMFKVRKQSIFAPIIGLFGRKQKD

SEQ ID NO: 62 - protein, 1638 aa, Pichia pastoris
MNSYNESAPTGCSFWDNDDISPCIRKSLLDSYLPAAIVVGSLLYLLLIGAQQIKTHRKLYAKDETQPLLEPANGSPTDYSNTYGTIDYEEEQSTAELTTSQKHFDISRLEPLKDDGTPLGLVKYVQRDGWEKVKLILEFVILIFQLVIAVVALFVPSLNQEWEGYKLTPIVRVFVWIFLFALGSIRALNKSGPFPLANISLLYYIVNIVPSALSFRSVLIHPQNSQLVNYYYSFQFINNTLLFLLLGSARVFDHPSVLFDTDDGVKPSPENNSNFFEIVTYSWIDPLIFKAYKTPLQFNDIWGLRIDDYAYFLLRRFKDLGFTRTFTYKIFYFSKGDLAAQALWASIDSMLIFGPSLLLKRILEYVDNPGMTSRNMAWLYVLTMFFIQISDSLVSGRSLYLGRRVCIRMKALIIGEVYAKALRRRMTSPEELIEEVDPKDGKAPIADQTSKEESKSTELGGIINLMAVDASKVSELCSYLHFFVNSFFMIIVAVTLLYRLLGWSALAGSSSILILLPLNYKLASKIGEFQKEMLGITDNRIQKLNEAFQSIRIIKFFAWEENFAKEIMKVRNEEIRYLRYRVIVWTCSAFVWFITPTLVTLISFYFYVVFQGKILTTPVAFTALSLFNLLRSPLDQLSDMLSFMVQSKVSLDRVQKFLEEQESDKYEQLTHTRGANSPEVGFENATLSWNKGSKNDFQLKDIDIAFKVGKLNVIIGPTGSGKTSLLLGLLGEMQLTNGKIFLPGSTPRDELIPNPETGMTEAVAYCSQIAWLLNDTVKNNIVFAAPFNQQRYDAVIDACGLTRDLKVLDAGDATEIGEKGITLSGGQKQRVSLARALYSNARHVLLDDCLSAVDSHTAAWIYENCITGPLMKDRTCILVSHNVALTVRDAAWIVAMDNGRVLEQGTCEDLLSSGSLGHDDLVSTVISSRSQSSVNLKQLNVSDTSEIHQKLKKIAESDKADQLDEERLSPRGKLIEDETKSSGAVSWEVYKFYGRAFGGVFIWFVFVAAFAASQGSNIMQSVWLKIWAAANDKLVSPAFTMSIDRSLNALKEGFRASVASVEWSRPLGGEMFRVYGEESSHSSGYYITIYALIGLSYALISAFRVYVVFMGGIVASNKIFEDMLTKIFNAKLRFFDSTPIGRIMNRFSKDTESIDQELAPYAEGFIVSVLQCGATILLICIITPGFIVFAAFIVIIYYYIGALYLASSRELKRYDSITVSPIHQHFSETLVGVTTIRAYGDERRFMRQNLEKIDNNNRSFFYLWVANRWLALRVDFVGALVSLLSAAFVMLSIGHIDAGMAGLSLSYAIAFTQSALWVVRLYSVVEMNMNSVERLEEYLNIDQEPDREIPDNKPPSSWPETGEIEVDDVSLRYAPSLPKVIKNVSFKVEPRSKIGIVGRTGAGKSTIITAFFRFVDPESGSIKIDGIDITSIGLKDLRNAVTIIPQDPTLFTGTIRSNLDPFNQYSDAEIFESLKRVNLVSTDEPTSGSSSDNIEDSNENVNKFLNLNNTVSEGGSNLSQGQRQLTCLARSLLKSPKIILLDEATASIDYNTDSKIQTTIREEFSDSTILTIAHRLRSIIDYDKILVMDAGRVVEYDDPYKLISDQNSLFYSMCSNSGELDTLVKLAKEAFIAKRNKK

SEQ ID NO: 63 - protein, 1495 aa, Calathea utilis
MSSTEKSSEDSIDTNDGVNTYRGFDADVQEQVQDLARILTNKSYSSSCQNKADSDLLSRVSTVAPGVDPITGLEQLDPRLDPNSSDFSSRYWIKNFRALMDKDPEHYNNYSLGITYKNLRAYGEATDADYQSNVVNAPAKLFGGLYKKYFRTSSAKEKVQFDILKSMDGIIKPGEVVVVLGRPGSGCTTLLKTIASNTHGFDIAPESEITYDGLTPQEVVKSFRGEIVYNAEADIHFPHLTVWQTLYTAAKFRTPENRIPGVSREEFAAALTKVYMATYGLTHTKNTRVGSELVRGVSGGERKRVSIAEVSLAGSKLQCWDNATRGLDAATALEFIRALRTSADVLDTTALIAIYQCSQEAYDLFDKVSVLYEGYQIYFGRGDKAREYFIKMGWDCPQRQTTADFLTSVTSPRERVARKGYESKVPKTGKEFEAYWKASPEYAELMKEIDANLHQTSQSSTKDVILSAKHARQSKNMRKSSPFTVSFPMQVRYLLTREFQRIRNDIFFHAFSVLSNSLMSLVLSSIFYNLQNDTASFYYRGAAMFLAVLFNSFASFLEIMSLFEARPIIEKHKQFALYHPAADALASVISQTPFKMITALFFNLVFYFMVNLRRDPGRFFFYFFVNILATFTMSHAFRLIGSMSNSLAQALVPAHIILLGLVMFLGFTLPTPYMLGWCRWMNYLNPLAYTFEALMANEFHDREFDCTQFIPGNPNEHPEWPSAAWVCDAVGAVAGEYSVSGDAYLSLSYDYSNGHKWRNVGILIAFLVVLLAVYMLFAEFNESAKQKGEVLLFQWSTLRKIKKDKASNDLEAGKERDVTEQNDEGDDVNVEALQAGKDIFHWRDVHYTVKIKTEEREILAGVDGWVKPGTLTALMGASGAGKTTLLDVLASRVTMGVVTGNMFVNGHLRDSSFQRSTGYVQQQDLHLDTATVREALRFSAYLRQPSSVSKKEKDDYVEEVIKILDMQKYADAVVGVAGEGLNVEQRKRLTIGVELAAKPKLLLFFDEPTSGLDSQTAWSICQLMRKLANHGQAILCTIHQPSAILMQEFDRLLFLARGGRTIYFGDLGKNCQTLIDYFESHGSPKCPPEANPAEWMLHVIGAAPGSHANQDYHQVWLESDERKAVLAELDHMEKELVKLPKDESIGNDEFAAPFYKQFLLVTERVFQQTFRTPSYIWSKLCLSIIPSIYIGFVFFNANATMQGLQNQMFSVLMFITIFNPLLQQMLPTYVAARDLYEMRERPSKTFSWKAFMLSEIVSEIPWNALIGTIAFFCWYYPAGFYHNSHSTAEVNQRGAYAWFFCVMFFVYIGTMAHMCIAPIRLEDMAGTIAYLFFTLCITFCGVMVSPDILPGFWIFMYRVSPMTYFVSGYLANAVAHADVICAENEYRVVTPPPGVSSCGEYFESYIEAAGTGYLINPNAADQCQFCPLSSTDDWLHSVGISYGEKWRNLGLLWVYMIFNVVAAIFLYWLARVPKKSGRVKEQASSKPSTQKEKSS

SEQ ID NO: 64 - protein, 567 aa, Saccharomyces cerevisiae
MAGATSSIIRENDFEDELAERMQSYNRETADKLALTRTESVKPEPEITAPPHSRFSRSFKTVLIAQCAFTGFFSTIAGAIYYPVLSVIERKFDIDEELVNVTVVVYFVFQGLAPTFMGGFADSLGRRPVVLVAIVIYFGACIGLACAQTYAQIIVLRCLQAAGISPVIAINSGIMGDVTTRAERGGYVGYVAGFQVLGSAFGALIGAGLSSRWGWRAIFWFLAIGSGICFLASFLILPETKRNISGNGSVTPKSYLNRAPILVLPTVRKSLHLDNPDYETLELPTQLNLLAPFKILKAYEICILMLVAGLQFAMYTTHLTALSTALSKQYHLTVAKVGLCYLPSGICTLCSIVIAGRYLNWNYRRRLKYYQNWLGKKRSKLLEEHDNDLNLVQRIIENDPKYTFNIFKARLQPAFVTLLLSSSGFCAYGWCITVKAPLAAVLCMSGFASLFSNCILTFSTTLIVDLFPTKTSTATGCLNLFRCILSAVFIAALSKMVEKMKFGGVFTFLGALTSSSSILLFILLRKGKELAFKRKKQELGVNQEIKLLESKENVPFDRSTTEKEELV

SEQ ID NO: 65 - protein, 1496 aa, Hansenula polymorpha
MSDSISVKSGDSQYFGFDSNVETQVRGLARELSHVSAYETEKNDNDARSLIRTLTNYSQVPGVNPFVEDGIDSRLNPDSDDFDSKLWIQNMRKLMDSDPEYYKPASLSVAFRNLRASGVVSSEDYQTTILTAPIKFVMENFNNTFRKHVESRYFDILKPMDGLILPGTFTLVLGRPGAGCSTFLKTVASQTYGFKVAPESIISYDGFSPKDIESNYRGEVTFSAEKDEHYPQLTVRQTLGFAAKLKAPRNRPQGVSAQAYADHMTKVYMAMYGLSHTADTKVGNDFVKGVSGGERKRVSTAELSLCGSKIQCWDNSTRGLDSATALEFLRALKTSATVLRTTPITSVYQCSEDSYNLFDNVLLLYEGYQIYYGPASHAKQFFQKMGYVCPPRQTTADFLTSLTSPKERIPREGMENRVPRTPKEFNDYWRQSPEYADMVAQTDAYIKKSAADDLREQFHQSHVARQEKGSRSRSPYTSTYWTQVRENMRRYWWKIKGDPSLLYFHIFFRVAISLVISSLYYNLKNTTSDLYYRGACMFFATMFNAMSVMMEVITCFEARQIAEKHKKYALYHPSTDALASVITEIPNKVIINTGFNLVFYFMVNFRRTPGHFFFYLLTNLTSTFTMSHMMRSLASLFRTLSEAMTPSMFLVSLLVLYTGFAVPVKDMHGWSRWINYLDPIAYAFEALIANEFHGRQFECNDFIPGYPGVPQENTICNTLGAEAGETTISGTKYIALAYKYYAKHKWRNWGINLSFAIFFLGVYLLLVENSKSAMQKGDVLLFLSSWFKTPTHARAKSDIETANNIESVNYAKDEAGSSSDSGRLATGNGIFHWRDVCFDIKVGKKPKRILDHVDGWVKPGTLTALMGASGAGKTTLLDVLANRVTIGVVTGSIFVNGQERNQSFQRFTGYAQQQDLHIQTATVRESLRFSAYLRQDASVSKQEKDDYVEEIIRVLEMESYADAVVGEAGQGLNIEQRKRLTIGVELVAKPQLLLFLDEPTSGLDSQTAWSICQLMRKLSNSGQAILCTIHQPSARLLQEFDRLLFLAAGGKTVYFGELGPNCQTLIDYFEKNGAKPCPPHANPAEWMLEVIGAAPGSHAKRDYHEVWTHSPERAAVLEELHRLEETADEKTHQEEAKQRQFATSFATQYHLVTKRMVQQYIRTPSYIYSKLLMAIGVSMFNGFTFFHANHTKQGLQDQMLSIYLMCMSGMVYFQQLLPLIEEERNVYEVRERPSKLYSWYAFVSATFTAELPWSFITGTLSFVTWYLPLGLYRDAEQTNSVSERAGLVWLYLTFFYMYATTLGYFCSFGLQVMSNGMNNSFMVFMLSMNFSGVLIYPTGFWTWLYHVSPLTWWIGGIVPAGIRDTRIRCASDEYVKFPPLSGQTCGQYMQEFITKNGGGYVVNPDATDMCEFCSMSNSNQFLLGRHMNPDHMWRNFGLIIAYTAFNIICTYAFYYIFRVPKKGSRVEKETFFIEEEDEEDEKAAPKKWWQKLGKKN

SEQ ID NO: 66 - protein, 578 aa, Saccharomyces cerevisiae
MGSCCSCLKDSSDEASVSPIADNEREAVTLLLGYLEDKDQLDFYSGGPLKALTTLVYSDNLNLQRSAALAFAEITEKYVRQVSREVLEPILILLQSQDPQIQVAACAALGNLAVNNENKLLIVEMGGLEPLINQMMGDNVEVQCNAVGCITNLATRDDNKHKIATSGALIPLTKLAKSKHIRVQRNATGALLNMTHSEENRKELVNAGAVPVLVSLLSSTDPDVQYYCTTALSNIAVDEANRKKLAQTEPRLVSKLVSLMDSPSSRVKCQATLALRNLASDTSYQLEIVRAGGLPHLVKLIQSDSIPLVLASVACIRNISIHPLNEGLIVDAGFLKPLVRLLDYKDSEEIQCHAVSTLRNLAASSEKNRKEFFESGAVEKCKELALDSPVSVQSEISACFAILALADVSKLDLLEANILDALIPMTFSQNQEVSGNAAAALANLCSRVNNYTKIIEAWDRPNEGIRGFLIRFLKSDYATFEHIALWTILQLLESHNDKVEDLVKNDDDIINGVRKMADVTFERLQRSGIDVKNPGSNNNPSSNDNNSNNNDTGSEHQPVEDASLELYNITQQILQFLH

SEQ ID NO: 67 - protein, 1515 aa, Kluyveromyces marxianus
MGQSERAALIAFASRNTTECWLCRDKEGFGPISYYGDFTVCFIDGVLLNFAALFMLIFGTYQVVKLSKKEHPGIKYRRDWLLFSRITLVGCFLLFTSMAAYYSSEKHESIALTSQYTLTLMSIFVALMLHWVEYHRSRISNGIVLFYWLFETLFQGSKWVNFSIRHAYNLNHEWPVSYSVYILTIFQTISAFMILILEAGFEKPLPSYQRVIESYSKQKRNPVDNSHIFQRLSFSWMTELMKTGYKKYLTEQDLYKLPKSFGAKEISHKFSERWQYQLKHKANPSLAWALLSTFGGKILLGGIFKVAYDILQFTQPQLLRILIKFVSDYTSTPEPQLPLVRGVMLSIAMFVVSVVQTSILHQYFLNAFDTGMHIKSGMTSVIYQKALVLSSEASASSSTGDIVNLMSVDVQRLQDLTQWGQIIWSGPFQIILCLVSLYKLLGPCMWVGVIIMIIMIPINSVIVRIQKKLQKIQMKNKDERTRVTSEILNNIKSLKVYGWEIPYKAKLDHVRNDKELKNLKKMGCTLALASFQFNIVPFLVSCSTFAVFVFTEDRPLSTDLVFPALTLFNLLSFPLAVVPNAISSFIEASVSVNRLYAFLTNEELQTDAVHREPKVNNIGDEGVKVSDATFLWQRKPEYKVALKNINFSAKKGELTCIVGKVGSGKSALIQSLLGDLIRVKGYAAVHGSVAYVSQVAWIMNGTVKDNIIFGHKYDPEFYELTIKACALAIDLSMLPDGDQTLVGEKGISLSGGQKARLSLARAVYARADTYLLDDPLAAVDEHVAKHLIEHVLGPHGLLHSKTKVLATNKISVLSIADSITLMENGEIIQQGTYEETNNTTDSPLSKLISEFGKKGKATPSQSTTSLTKLATSDLGSSSDSKVSDVSIDVSQLDTENLTEAEELKSLRRASMATLGSIGFDDDENIARREHREQGKVKWDIYMEYARACNPRSVCVFLFFIVLSMLLSVLGNFWLKHWSEVNTGEGYNPHAARYLLIYFALGVGSALATLIQTIVLWVFCTIHGSRYLHDAMATSVLKAPMSFFETTPIGRILNRFSNDIYKVDEVLGRTFSQFFANVVKVSFTIIVICMATWQFIFIILPLSVLYIYYQQYYLRTSRELRRLDSVTRSPIYAHFQETLGGLTTIRGYSQQTRFVHINQTRVDNNMSAFYPSVNANRWLAFRLEFIGSIIILGSSMLAVIRLGNGTLTAGMIGLSLSFALQITQSLNWIVRMTVEVETNIVSVERIKEYAELKSEAPYIIEDHRPPASWPEKGDVKFVNYSTRYRPELELILKDINLHILPKEKIGIVGRTGAGKSSLTLALFRIIEAASGHIIIDGIPIDSIGLADLRHRLSIIPQDSQIFEGTIRENIDPSKQYTDEQIWDALELSHLKNHVKNMGPDGLETMLSEGGGNLSVGQRQLMCLARALLISSKILVLDEATAAVDVETDQLIQKTIREAFKERTILTIAHRINTIMDSDRIIVLDKGRVTEFDTPANLLNKKDSIFYSLCVEAGLAE

SEQ ID NO: 68 - protein, 802 aa, Unknown
  ABC Transporter Polypeptide
MAAFSSLVASQDVLYRLLADLARKDTKSFRRTLAQLDRRTRLIIALVSALSSASVVALVRHNAKSAKQEATRARELHRQNSAVKLNDGSQEIFVPSGGSKGGQSRVVIRPTRRVTFEAHRRLFLKSPEKTTMGGEHKTGINRTFMREFGAIWSIIVPHLKSKTSGLLFIHALFLAARTYLSLLVAKLDGRIVRDLIAGHGRQFARGIVLWLLLAIPASYTNAMIKFMQAKISIAFRTRLVRYIHDIYLDAKLGYYKVSNIDGGIEGADQYITADVTRFCDAAAALYSNLGKPSVDFAIFSYQLYQNLGPLALIGIFGNYMATAWVLKRLAPPFGWLTAVEARLEGEYRSGHTKLITNAEEIAFYDGTGLERSILRDTYRRLTRHVANILRIKVSYNMFEDFMLKYSWSAMGYIFASLPVFLPTWAGANSHALVEAKDHEEKPHSASIATARRDFQERSRMREFITNKRLMLSLADAGGRMMYSIKDLAELAGYTSRVYQLLSTLHRVHASAYDRAPGSGPIEPYSLADVRGTVQQGFKGVRFEHTPVVVPGLGKDNSPGELLIKDLDIRINPGDHILISGANGVGKSAIARVIGGLWPVYRGLVSKPMPSDISFVPQRPYLSNGTLRDQIIYPASHADMLDAKRSDDELMEILKKVKLEYLPSREGGWETKKQWKDVFSGGEKQRVMFARILYKKPMFAVIDEGTSAVSADVEGLLYETCKKQGITLITISHRPSLLQYHNAQLKIGLGDHRDEWVLEKTDTEEGRLSVEHEIEELEKQLSQVDAWKARRHEIDALLSGKSQ

SEQ ID NO: 69 - protein, 1068 aa, Saccharomyces cerevisiae
MRGLTPKNGVHIETGPDTESSADSSNFSTGFSGKIRKPRSKVSKACDNCRKRKIKCNGKFPCASCEIYSCECTFSTRQGGARIKNLHKTSLEGTTVQVKEETDSSSTSFSNPQRCTDGPCAVEQPTKFFENFKLGGRSSGDNSGSDGKNDDDVNRNGFYEDDSESQATLTSLQTTLKNLKEMAHLGTHVTSAIESIELQISDLLKRWEPKVRTKELATTKFYPNKSIETQLMKNKYCDVVHLTRYAAWSNNKKDQDTSSQPLIDEIFGLYSPFQFLSLQGIGKCFQNYRSKSKCEIFPRTAKETIYIMLRFFDVCFHHINQGCVSIANPLENYLQKMNLLPSTPSSISSAGSPNTAHTKSHVALVINHLPQPFVRNITGISNSELLSEMNNDISMFGILLKMLDMHKNSYKNFLMEITSNPSVAKNTQSIDVLQEFIHYCQAGEALIALCYSYYNSTLYNYVDFTCDITHLEQLLYFLDLLFWLSEIYGFEKVLNVAVHFVSRVGLSRWEFYVGLDENFAERRRNLWWKAFYFEKTLASKLGYPSNIDDSKINCLLPKNFRDVGFLDNRDFIENVHLVRRSEAFDNMCISDLKYYGELAVLQIVSHFSSSVLFNEKFTSIRNTSKPSVVREKLLFEVLEIFNETEMKYDAIKEQTGKLFDIAFSKDSTELKVSREDKIMASKFVLFYEHHFCRMVNESDNIVARLCVHRRPSILIENLKIYLHKIYKSWTDMNKILLDFDNDYSVYRSFAHYSISCIILVSQAFSVAEFIKVNDVVNMIRVFKRFLDIKIFSENETNEHVFNSQSFKDYTRAFSFLTIVARIMLLAYGESSSTNLDVISKYIDENAPDLKGIIELVLDTNSCAYRFLLEPVQKSGFHLTVSQMLKNRKFQEPLMSNEDNKQMKHNSGKNLNPDLPSLKTGISCLLNGIESPQLPFNGRSAPSPVRNNSLPEFAQLPSFRSLSVSDMINPDYAQPTNGQNNTQVQSNKPINAQQQIPTSVQVPFMNTNEINNNNNNNNNNKNNINNINNNNSNNFSATSFNLGTLDEFVNNGDLEDLYSILWSDVYPDS

SEQ ID NO: 70 - protein, 116 aa, Saccharomyces cerevisiae
MRWDVIILYAISRPYATRRTGSHTHPRDSRYIAANQRRPPSACRVGPSPAKQRKDIPIFELLDTTLIKNALFALTSFLYYRTNILTCPFLNFLYLSRTGQLDKFCKDQTVTQILAT

SEQ ID NO: 71 - protein, 1243 aa, Pichia pastoris
MKENDTPRVGISVRDLAVVTKKSRRAFFSSSSKRNDVPTSKVLLEATSFDIEPGTITAIMGGSGSGKTTMLNCLANGNENSGNINIQGTIAYNGKTNINTISHAYVIQQDILLPNLTCYETLMYSAELRLKEPKEKLVEIVDQVILELGLKDCRNTLVGNDTHKGLSGGEKRRLSIGIQMLCNPSVLFLDEPTTGLDAYSALLLIQTLKNLANQGKTFVLSIHQPRSDIFFLFDNLILLSRGKTCYSGPLDKVIPYFEQIGYHVPKQVNPADYFIEIVSINMKDQETENKCWESLSKISDHWKDSHDFEPISVDPTFVSKVKSPVSFSKKIKILTRRDMLLSFRSPLILLSLLIETIAVSLICGWVFFIPGSSLRGIRTMTGALYTTNGLQPYLFLLFEVYRLSSVDIKIYDRERSEGVVSAPSFLISRRISKFFTEDVWIPILESIIGYFMFGLRTDSPRHFFIYFAAVYIAHLVSMCFAMACVSISREYALASLMANLNFTLQSMACGYLANSRVIPVYVRWTKYIAYLWYGYGAVISNQFTGFRGECFQDTSQPNIDEVCAAYYGNNIIRNLGFWPNFIALPLCVEVAMAFGFYLFAGLMLTYKTKSRSALSQEVSSSSKRKSLKSSTQDATKEAEVLVRDGLTITLKDASLKVRVRKVLERTSTEKEILHGVNAEFKPGQLNTIMGPSGSGKSSLLNLISGRLHSNVTTSYTSIGDIFLDSQLASFQDMDEICSYVSQDGDHLIPSLSVRETLLFAARLRLNLERHQVEKRVDEIILKMGLRDVATVLVGSEFVKGISGGERKRLSIAIQLINDPPILLLDEPTSGLDAFTAGSILKVLQTLCDENKTVVLTIHQPRLDLFHSLGSILLLAKGGHVAFKGTPNEMLEHFESMGYPCPAFVNAADHVLDVISVNVQNEINETISRKRVNLFLDEWKSRDNQETKLLAVNTFSMEDVAIKKRSSFMKGYTILLQRQALCIRRDTNILFGRIAQIAGLGIILALFYSPLKHDYTSIQQRLGALQQMTALYFIGMLNNIMIFPLERTSFYTEYKDKVVSAESFFMAYLTLELPFELVSGAFFSVFMVMVIGFPRTPGLFFAMYYASICIVNCGESLGVIFNVIFDEVGFAVNIISIFLSIATFMTGVMSLNMGAFLRGINWLSPLYYAVMGVLNLAFPPSLRLTCEDDFRNPDGSCIFSNGTDVLEIYQLKKNWQLLLGLLIVVVFVYRGIGYVMLKLKVRGF

SEQ ID NO: 72 - protein, 539 aa, Saccharomyces cerevisiae
MSTNKFVVRITNALFKSSLASNSPPVYPKRIRHFEILPNEKWVIWGPGKGKFLDVLNNKYICEPPLSLRFGFLKESSNILPRIEQVAFKGVMPTAHLSARYEYFKDDYDQTCKQFIFDKASGSNAVSYKVETNNRQINMELYNALVENLNLSSLQDRWVMGLSNGQMRRARLARSILKEPDLLLIDDPFLGLDPAATATISQFLAKYDSIEVSGGCPIVIGLRYQDTIPAWCTHICCVDEKNGILFEGPIEKLQSKMDETRSRALKELEQLKKASNSKEDISINDLICIHPMYGKKEHEIIKMPHLIELDGLSVSYKGEAVLENLHWKVQPGSKWHIRGDNGSGKSTLLSLLTAEHPQSWNSRVIDNGVPRRTGKTNYFDLNSKIGMSSPELHAIFLKNAGGRLNIRESVATGYHEASSNNYLPIWKRLDKNSQDIVNMYLKYFGLDKDADSVLFEQLSVSDQKLVLFVRSLIKMPQILILDEAFSGMEVEPMMRCHEFLEEWPGTVLVVAHVAEETPKCAHYLRLISPGEYEIGDMEN

SEQ ID NO: 73 - protein, 160 aa, Pichia pastoris
MTELCPVYAPFFGAIGCASAIIFTSLGAAYGTAKSGVGICATCVLRPDLLFKNIVPVIMAGIIAIYGLVVSVLVCYSLGQKQALYTGFIQLGAGLSVGLSGLAAGFAIGIVGDAGVRGSSQQPRLFVGMILILIFAEVLGLYGLIVALLLNSRATQDVVC

SEQ ID NO: 74 - protein, 930 aa, Unknown
  ABC Transporter Polypeptide
MANVSTLRPLLIEALQDPVKLRAFISTYLASLRQMSPRRLRVIAVVAFLLVGSCTGIAGQALLDNLNTKKSKKKVPLHRMDSAVKLSDGSKQIVVPYKEGQTTVTIKPTKQVTFEAHRRLFLRPDDSEGGEAKSGINGRFLRQFSALWVIMVPRLQSRESLILLVHALFLFLRTWISLLVAKLDGQIVRDMIAGDGRKFLRGLGYWFAIAVPASYTNAVIKYLQAKLSLAFRTRLTRYVHDLYLDADLAYYKIADIDGGNVGTSADQFITTDLARFCDKAAALYSNLGKPFVDFLIFTFQLSKNLGPMALIGIFANYGLTAYLLRRLAPSFGKLAAIQAKLEGEYRAAHSKLITNAEEIAFYDGTSLERTILEKAYIRLARHIRGIYRIKIFYNMFEDIILKYTWSAIGYMFASLPVFLPAWTSIKEKTKETTASAVTASMDFSEQDHMRDFITNKRLMLSLADAGGRMMYSIKDLAELSGYTSRVYMLLSVLHRVHARAYTSRILKTPIKEAASKEAKEEGIVIGEKPDPDSSSELSEEEQFTLNSISGTIQPRYPGVRFEGVPIVAPSAVGSGELLVRDLNVLIKPGEHILISGPNGCGKSAVARVIGGLWPVYRGLLSRPDISEIGFLPQRAYLSIGSLRDQIIYPDSHADMISKNVTDADLQTILDRVHLGYLPSREGGWNTRKEWKDVFSGGEKQRVMFARILYHRPKFAVIDEGTAAVSSDVEGSLYENCKKDGITLITISHRPSLMKYHKAQLKLGLGNDGKDWDLEIVGSKEARLSVEKEIQSLEEKLSKVDEWKKRKTEVEAILRGEVKHEQKPGFQEIVTENVQNTGDDTGVLLKTDTIVGVGKESEEEDVKEMKQQLGSVVKAEGDAAVKEQAAKELNEATEKLEAAKEKTDKGDVKVEGGADKPAAAKTSNPKKSEKK

SEQ ID NO: 75 - protein, 1081 aa, Saccharomyces cerevisiae
MSSIHEVVALIEELYSPHPKHDVNQIQQSLQSIQKSEQGFHLANELLSDDKYSANVKYFGALTLTVQLNTRGENDYETLWNVFRSNLLYLTKFSTLYVSNPNMYGQSLIIIKKLMSNLSLIFTKINDPQLNNAGNENMIKQWNNPINTFIQLMSVQNQNINADQLLLDSINCSLTYEQLSQFVSLSQKHNELALTFTEVIVEDLTKFQTKRHSMSQIHEVVHEHLYISTMALINLNLTAQAVFNPTVFDCITAWINYISLTRSVSSSGRMDLSEIFQNLIDLMYQSTEGSDGYENAEKILTIFGNVFANDPLLMSYDLRQQIECIFLGVVRPDSGITDISNKNSWMLQYMNYLVTNDFFSELKELAICIVDFLQINTLSVCNKLFTNIQAADNGQVQDEYIQEYIKVLLQMTNFPLTPVLQEFFSVRMVDFWLDLSDAYTNLASETLRPNSIELSTQIFQQLINIYLPKISLSVKQRIIEEEGESTSVNEFEDFRNAVSDLAQSLWSILGNDNLTNVLIDGMGQMPAASDETLIIKDTDVLFRIETMCFVLNTILVDMTLSESPWIKNIVDANKFFNQNVISVFQTGFQTSASTKVSQILKLDFVRTSTTLIGTLAGYFKQEPFQLNPYVEALFQGLHTCTNFTSKNEQEKISNDKLEVMVIKTVSTLCETCREELTPYLMHFISFLNTVIMPDSNVSHFTRTKLVRSIGYVVQCQVSNGPEEQAKYILQLTNLLSGSIEHCLASSVQLQEQQDYINCLLYCISELATSLIQPTEIIENDALLQRLSEFQSFWSSDPLQIRSKIMCTIDKVLDNSIYCKNSAFVEIGCLIVGKGLNLPDGEPYFLKYNMSEVMNFVLRHVPNCELATCLPYFVYLLEKLISEFRKELTPQEFDFMFEKILLVYYDAYIINDPDLLQMTIGFVNNVLDVKPGLAIGSKHWTSFILPQFLKLIPSREKFTIVAVAKFWTKLINNKKYNQEELTTVRQQVSSIGGDLVYQIMYGLFHTQRSDLNSYTDLLRALVAKFPIEAREWLVAVLPQICNNPAGHEKFINKLLITRGSRAAGNVILQWWLDCTTLPNYQG

SEQ ID NO: 76 - protein, 555 aa, Saccharomyces cerevisiae
MSTDESEDVYSDLYSIISQVTSNTANDIEQLPYALTFKTSLIFVGATIGGLLFGYDTGVISGVLLSLKPEDLSLVVLTDVQKELITSSTSVGSFFGSILAFPLADRYGRRITLAICCSIFILAAIGMAIARTLTFLICGRLLVGIAVGVSAQCVPLFLSEISPSRIRGFMLTLNIIAITGGQLVSYVIASLMKEIDNSWRYLFALSAIPAILFLSILDFIPESPRWSISKGDILYTRDSLRMLYPTASTYHVNSKIKQLIIELDKLRLYEDASEPLLVQSQSVIRYMDSSTSGTLSPPNIKRLSSNTERTSNTMSSSSAYLSALRGPAPNGALASNKKKRHRMEPRTIRALIVGCMLMFFQQITGFNAFMYYAAIIFSKFNIKNPLLPPILIASTNFIFTFFAMYTMDSLGRRAILLRTILIMTVGLLLCSVGFGHDQVNLLLISVVIYVAAYASAMGSVPWTCVEFLPLNRRSFGASCIACTNWLTNAFVSMTYLSTINTIGDENTMLIFAFFTVCAWFFVYFWYPEVKGLSLEEVGRVFDNGIDVHYVFRTYH

SEQ ID NO: 77 - protein, 488 aa, Saccharomyces cerevisiae
MAETERLMPNGGSRETKPLITGHLILGTIVACLGSIQYGYHIAELNAPQEFLSCSRFEAPDENISYDDTWVGQHGLKQCIALTDSQYGAITSIFSIGGLFGSYYAGNWANRYGRKYVSMGASAMCMVSSLLLFFSNSYLQLLFGRFLVGMSCGTAIVITPLFINEIAPVEWRWAMGSMNQVSINLGILLTQTLALKYADSYNWRWLLFSGSVIAVANILAWLKVDESPRWLVSHGFVSEAETALFKLRPGTYQQAKQEIQDWQRSHGHNRDPESSEETHSGPTLWQYVTDPSYKKPRTVILAILSCQQFCGINSIIFYGVKVIGKILPDYSIQVNFAISILNVVVTLAASAIIDHVGRRPLLLASTTVMTAMSLLISVGLTLSVSFLLVTATFVYIAAFAIGLGPIPFLIIGELSYPQDAATAQSFGTVCNWLATFIVGYLFPIGHGLMGGYVFAIFAAIAAMFATYVYKRVPETKGKTTYSEVWAGY

SEQ ID NO: 78 - protein, 1568 aa, Kluyveromyces lactis
MIMLQVPNATCEFGLRPYISPEVNALNPCFISWVCVIFVAHFIAIGGFQYVSLRNKETGPATFETKRFWTFRNMSIFHVIHMINVLFQCVLLLIQLSWVKDEPTWTKWSISLNLFYVAIVYLNSTWLAYYKSSCAQGHGLFYFIIYSFVVAFEIGQRYFHAGTERYNVIKNGASAMIVDILLWFNSMSIFCYDTFLFKCSPQLTNYFAVNNIYPPVNVLAGISFTWMNKLIMDTYHANKIEDPSNMPLPPFDLDIAEATTAVEANWEYELWTDRKSLLLALLKTFGPTIAIAMSYEVSRSLLSVIQPQLFRKFIEVFNPDSRDLPILNGFFVAIGLFLLSILSTIISNQFFINIFEAGLKIRGSLMSLVYQKSLRLSAEAREDKANGDVLNLMSVDVIRIQRFFENAQILVGSPIQLIGVLISLYVLLGNATIGGLVSIVIMVPINSYMTRLYKKLFKTQMQYKDKRIKTVTEILNSMKSIKLYAWEKPMLDRLNHVRNDLELHNMKKIAIVSNFMFFCWNIVPLLVTCSTFVLFSYLTDQVLSPQIIFPSLTLFSMLNDALFTVPTMISNIIEIGVSLKRLKGYLLAEELDTSFIEHARATASDPTVEISNAVFLWKSPKSAASSEDTDEEAEISSPGVALKSIENFSAKKAQLTCIVGRVGSGKSTFLQAILGQLPCVSSDSASGVKPKVVIRADNLAYCPQQPWIMNASLKDNILFGYKYDEAMYKKTIKACQLLPDLEILPDGDQTLVGEKGISLSGGQKARLSLARAVYSRADLYLLDDVLSAVDSHVCKSIIDDVLDRQKGLLKNKTVILTTNAVNVLVHSDMIYLLKNGKIVESNSYEEVMSKDRNNGEKSSLREIIEEFASNESEETAEKKSESSTIDDKNVGSSSEDDGDLEGAPQPPEHLLNYEAAKNPDNNTITAYEEDQENADLARVASRRASIATLKPRPLIDMNKDERKTAQKAETKEEGRVKSSVYLSYIKACGILGVALFFVLMISMKLLDLAKNFWLKHWSEDNLTHGANKDIWKYVAVYALIGVTSSAFELARTIIMMLFCSIRASKLFHNQMAHSVVMAPMSFFETTPVGRIVNRFSSDVNSIDEDFQHIISFFFRSMLDYLITIVIITVSMPWFLLFNTILLGIYYYYQTLYVVLSRELKRLTSISYSPVMSLLSETLGGHVVINAYKHANIFNYYNFENIQTNINFIFNFRSTNRWLSMRLQTIGAVIVLITSLMALASLGTSNPISAGLIGLLMSYALQVSSSLMWIIRMAVNIETTIVSVERIIEYRDLKPEGIRVIEDSRPPKNWPKRGEITFEHYTTKYRENLDPVLKDIDLRIKHQEKIGVVGRTGAGKSTLTLALFRILEPFEGKITIDGIDISTLGLYDLRRSLSIIPQDAQAFEGTVRSNLDPFNRHTDAEIWKALELSHLKPHIERIVSELPDDENKPTDLLDTQISDNGNNLSMGQRQLLCLSRALLNPSKILILDEATAAVDRETDKIIQETIRTAFKDRTILTIAHRIDTVLDSDKIMVLDKGEVKEFDTPDNLLKNKESLFYGLCEKGGYLKEE

SEQ ID NO: 79 - protein, 1352 aa, Pichia pastoris; identical to SEQ ID NO: 16

SEQ ID NO: 80 - protein, 1460 aa, Unknown
  ABC Transporter Polypeptide
MSSKADEDNIEAYNADSEGTDSMNEVHELARQITNQSIRSGTGSLHNPFVDSKDPALDPNSDDFDSRKWLRQVMNIKLRDPDNYPPGIAGVAFKNLGAFGYGTSADYQKTFLNATLEVVSLAKRIVGLEKKTKITILREFNGLVRPGEICIVLGRPGSGCTTLLKTLSQNTHGFHLTDETVLNYQGIPPEAIHKHFRGEFIYNAETDTHFPHLTVGQTLKFAALARTPKNRIEGVTRDQYATHLRDVTMATFGLSHTLNTKVGDDFIRGVSGGERKRVSLAEAFVNGSALQCWDNSTRGLDSATALEFIKTLKNHADYADVCCFVSLYQASQDAYDLFHKVTVLYEGRQIYFGPTDRAKKFFTDMGFVCPDRQTTGDFLTSLTNPDERIVAPGFEEKVPRTADDFEAVWRNSEDYRQLIAEIDEYNAAYPVGGEAFQQFQHSMVTKKANRARHGSPYTLNFGMQVQLCITRGFQRLFGDLSMAATTVFGNNAMALIVASIFYNMSQDTNSFFSRSALLFFSILMNAFSSALEILVLYAQRPIVEKHTRYAFYHPSAEAFASMLVDMPTKIITTLFFNIIIYFMTNLRREPGPFFIFYLFSFVCMLVMSMVFRTIAACSRTISEAMTPASIFILALVMYTGFAIPTRYMVVWFRWINYINPIGYAFETLMINEFNGRQFKCSGMMPTFENATGTERTCYVQGYNAPKGAEYIDGGEYIASAFGYYHAHKWRNFGILIGFMFFFLGTYLVATELIQAAKSKGEVLVFKKGHVPYGKGNDPEAGDVPAGAIRDPADSSGMISEKSSGQINLQKQTGIFQWMDVCYDIKVKGPEKTRRILTHVDGWVKPGTLTALMGASGAGKTTLLDVLASRVTMGVVTGDMLVNGKLRDESFQRKTGYVQQQDLHLETSTVREALTFSAVLRQPKSVPKEEKIAYVDEVIRILEMESYAEAVVGVPGEGLNVEQRKRLTIGVELAAKPELLLFLDEPTSGLDSQTAWSICSLMRKLANNGQAILCTIHQPSAMLFQQFDRLLFLAKGGRTVYFGDIGENSRTMIDYFERNGADPCPPDANPAEWMLTVIGAAPGSHANKDYHEVWVNSPERVTLRKELEEMAENLRNTPDDNNDNELHRSFASSLSTQLVEVTKRVWQQYWRTPSYIWAKIVLTTISPAFIGFSFWQAKNDMQGLQNQMFAFFMLITIFGNLIQQIMPHFVTQRALYEARERPSKTYSWPAFIISNVVVELPWQTLVSVLSFVVVYYPVGFYRNASWTDSVHERGALFFMLIWVYYLFVSTFAHMVIAGIETADTGGNIGNLLFTLTLLMCGVLATPSALPGFWIFMYRVSPFTYLIAGFMGSGIGNAPMKCSSRDYVHFDAPAGMTCQEYVGDFAASSGGYLLDGNATSCEYCPMSNTNQYLGALEMQPNDGWRNFGILFAYVAFNIFGALFFYWLLRVPKKRKIAKTKKE

SEQ ID NO: 81 - protein, 1022 aa, Kluyveromyces marxianus
MMLRISMSALLVYMWLTLAANAKLMNNEGVFDQVSVPPRNRRPPSDDQCPPCFNCMLPIFECKQFSECNSFNGRCECIDGFGGDDCSVPLCGALSSGNSKRPLRSNETNTCECESGWGGINCNICEEDYVCDAFMPSGLKGTCNKNGMIAKSLHQGCDVTNPKILEILKGSKPQVTFACNKTSELCNFQFWIDQVESFYCGLDTCSFEYDLQQNTTHYKCDNVKCKCVPGQMLCGKKGSIDISDFLTETIKGPGDFSCDLESKKCQFSEPSMNDLILTVFGDPYITLKCESGECLHYSEIPGYKTPDKSKLSTGSILVLVLSSAGVLVAISISVYFISKSPIFANSPIMLPDDSSDDDFDLYKTNSTATLTFENITYKVFPTKNTSTTILNEVTGSVKPGEMLAIMGGSGAGKTTLLDILAKKNKTGKVTGSIKVNGTEIDKEEYSKIIGFVDQDDYLLPTLTVYETVLNSALLRLPRQLSFKAKQKRVYDVLEQLRIYDIKDRVIGSEYERGISGGEKRRVSIACELVTSPQVLFLDEPTSGLDANNANNVIECLVRLANHYNKTLVVSIHQPRSSIFQLFDKLVLLSDGEMVYSGEAYKVSEFLKNEGYVCPQDYNIADYLIDVTFEPSKFITKATIDDVNATIPSTEAQNPIHRVEHARRSLTGTATQTEWEHLAIHRDEFRGLLAQSENEEQTIGEVNSQLLHSLFKDGQYFQKLKFEINELSSSGTEEELRIPHAYKAATFMQQVSILSSRTFKNVYRNPKLLLGNYMLTIFLGFFLGTLYYDVDNDISGFQNRLGLFFFILTYFGFLTFTGLSSFALERLIFIKERSNHYYSPLAYYMAKVISDILPLRVVPPILLGLIIYPLVGLNMANNGFGRFTLILVLFNLAVSLEILTVGIIFEDLNNSIIVSVLIILASLLFSGLFINTKDIENYFFKYLKNLSVFYYAYESLIINEVKSLMLREKKYGLNIEIPGATILSTFGFIVQNFVFDIEILVLFNVLFLVLGYLALQLIVVEQK

SEQ ID NO: 82 - protein, 1020 aa, Unknown
  ABC Transporter Polypeptide
MVSIRLVGLAVLSVTGVLATTSPLESDRPDECPPCFNCMLPAFSCKQFATCNEFNGRCECPDGFGGDDCSEPVCGGLSDGRNRPIRQGDECQCKEGWGGINCNMCEENDACDAFMPGGEAGTCYKGGILVNKNHQMCDVTNRKIVDILKGKKPQVTFSCNRTEAECNFQFWVDQRESFFCGLHDCEFETDFLSDKNVTRYSCPKIDCACVPGRMLCGEKGSIDISDFLTETIRGPGYFECDSKDDNCKFSEPSMNDLIKNVFGDSYITLTCDASECLHYTELPGYHEPVKRVNRAFVLSTSAIALAILILGGLGVNYLIQVSQEKKVNRIALPSDDDRAKLMMSHKPTSLQFDNVSYVDNDRQILSNAFGTVESGQVMAILGGSGAGKTTLLDILARKKKKGQAAGDIYVNGKQYSSKQYKRVIGFVDQEDYLMPTLTVYETIATSALLRLPKTMSDDAKRLRALETMNELGILDIKDQIIGDESNRGISGGEKRRVAIACELVTSPSILFLDEPTSGLDAYNAHNVIESLVNLARNFDRTVVVTIHQPRSNIFSLFDKVILLAQGKVVYSGAQIRAAEHFSELGYTCPPSYNLADYLIDLTMKNSDSSSGESTEGTSSSLLERTQEDDEDLHNPLARAGTDIDVTREWRHYASHRDEDRQLLRQRNTGDGSNGARAGGSGSGSRTTGTTAKVEELVEMFNGSTAYAEVKDDIQRATGNAAAAATSSSDEDDEGQELRGYETVGLVRQFTILSIRTFKNLYRNPMLLLTHYVIAIILGMFCGVLYFNISNDISGFQNRLGLFFFLLALFGFSTLTTLNLFAQERIVFVRERANGYYRPIAYYCAKVLFDIIPLRVFPPIILGMIIYPLAGLSTDNNAFWKFLLILTLFNLTAASICLVIGIVIQDSGVANLVGSLVMLFSLLFAGLFLNPDSMPPGTKWFEYASIFHYAYEALAVNEVRYLTLTERKFGLSIEVPGATILSTFGFDVGALWADVWGLVIFFLVFITWGYVAMHYMLIERR

SEQ ID NO: 83 - protein, 563 aa, Saccharomyces cerevisiae
MTKQQTSVMRNASIAKEEHEGSDNNNVDRSSSDAISDNDAERSNSHSEIDNESNFDMVPYSRFSHKQKMLLVVQCAFTGFFSTVAGSIYYPVLTIIERKFNITEELANVTIVVYFIFQGVAPSIMGGLADTFGRRPIVLWAILAYFCACIGLACAHNYAQILALRCLQAAGISPVIAINSGIMGDVTTKVERGGYVGLVAGFQVVGTAFGALIGAGLSSRWGWRAIFWFLAIGSGICLVFSTLLMPETKRTLVGNGSVTPRSFLNRSLILHVGSVKKTLHLDDPDPETLEPRTSVDFLAPLKILHIREIDILLSIAGLQFSTWTTHQTALTIVLSKKYNLSVAKIGLCFLPAGISTLTSIISAGRYLNWSYRTRKVKYNRWIKEQELQLMEKYKGDKNKVAELIHSNSHYTFNLVEARLHPAFVTLLLSSIGFTAFGWCISVKTPLAAVLCTSAFASLFSNCILTFSTTLIVDLFPSKASTATGCLNLFRCLLSAIFIAALTKMVEKMRYGGVFTFLSAITSSSSLLLFYLLKNGKQLSFDRIRANDKSAGRSVGKNSEKVST

SEQ ID NO: 84 - protein, 173 aa, Saccharomyces cerevisiae
MTHSLKALFALLFLYTAAVNAGVIGIFNALPPPNTKPINGESPLYQCDILDKQLVEIKEVNLDPNPPVRGENLTISANGEVFETIEEGAYIDVEVRLGYIRLLSQTFDLCETLEDNDIEGLSCPIEPGEYNIKKIVEIPGEVPPGKYVVVARAYTEKDDLITCLTGEVIFPPR

SEQ ID NO: 85 - protein, 687 aa, Saccharomyces cerevisiae
MKPPLNMSRSNKPLTQEANSSAHIDRAHQLAQDFNSKQDDTALTSLPHKNPDIFRFENNITAHSSRRGSLYRDSDATVVLPLSEHTPRLSMDDPYRQLLQQAEISQLRSKKKRHSSRVLRTSFISFVVLVSSLSGLDQGLISGNVMTLSFQKYFHYPLTSPLGNIVSIVNLGAFMASLFVYSGILEPCSRKKMLQISTMIYSLGAIVQVLALNQWCLLLGRFLLGVGMGFAFSMVIIYQFEFPLPCIRKRTLISIQCVSSVIAYSFGIWINCAFRYLGFAWRYPLSTHVALGIILNLMSFYLILESPSWLLKQKNDVEALVLISNVFDDGNFEENQTQLKFRVLKRDILLKSHLQKNSYPYAYILKDFSSIIKLLIGFQLLTRTNGVDAFLYYSPLILQQMGRGERKSIYLTGLNALIYSIVILAYVPLVLRKRKEKTNVLLGSIVMCALLFTISFTDWFPKSTTRYISILFAVFLFTHFISWDSIGWVMTIELLPHLSQAPVILLVSNFYWIFKWFVSLITPILIDRLSWKFYLIPSLSSFISIIFVLKIFPIETRDERLDSDDDSTGNGSGNHDDVFDDTGSEFSSSPSFSAYQINTLGSSIKQNNQAYSSIQNEQILPKNGNLSNQTHGSAQNVYFITSDSGPSRTGEFFSFHNRTDPNISDNIAANKPSSGGGQNSPGDMAVA

SEQ ID NO: 86 - protein, 1633 aa, Calathea utilis; identical to SEQ ID NO: 1

SEQ ID NO: 87 - protein, 206 aa, Unknown
  ABC Transporter Polypeptide
MESTPPDYTGLDPTIDAEIRSIAESVHKDRVDDYDTEKGTVGNEKLLRSDTVQPNLDVNPYIDNSDPQLDPLSDEFNARKWIKTVLGLKQRFGATKHITAGVSFKNLAAYGYGGGSQYQKTFSNSVLAIGPMIMELFGGNKGTKVQILRHFDGLVRAGETCVVLGRPGSGCTTFLKSVACETYGFHIEDKTEWNYQGEYELLRSPL

SEQ ID NO: 88 - protein, 1497 aa, Kluyveromyces marxianus
MNFGIKSQSEPSNYQPEYHGFDQQVERQVKELARSLSRASIDKQRYPAAFNSHISTNDESEHDDNKSITSIFSGVHEGVNPVYLDPSAPGYDARLDPNSEHFSSAAWIKNMVAFSMQDPEYYKHYTIGCCWKDLRAFGDSNDVSYQSTVTTLPGKYLGKIKRHFSATKEEDLFDILKPMDGLVKPGELLVVLGRPGAGCSTLLKTISANVEGYSIDPNSTISYNGLDPKVIKKHFRGEVVYNAEGDIHFPHLTVYETLYNVALLATPSNRIKGVSREEFAKHITEVAMATYGLSHTKNTKVGGDLVRGVSGGERKRVSIAEVTICGSKFQCWDNATRGLDSATALEFIRALKTSTDISGSTAVIAIYQCSQDTYDLFDKVCVLDEGFQIFFGYAKDAKKYFENMGYVCPPRQTTADFLTSVTNPAERIVNQDYVKEGRFIPSTAKEMEEYWRNSPEYKQLRADIEEELSKDSAKSLQELEESHIARQSDGQRKGSPYIVNYGMQVKYLTLRNILRIRRSYSITLGTIVSNTCMSLILGSAFYKSMKHTTTNTFFFRGAALYISVLFNAFSSMLEIFSLYEARPIIEKHKRYSLYHPSADALASMISELPGKFITAVFFNVILYFMANFRREPGPFFFYFMMNFLSTLVMSSIFRCLGSAAKTLPEAMVPSSVLLLIITLYVGFTIPKKNMLGWSKWLWYINPVSYVFESLMINEFNGRDFPCAVFIPSGPGYENVSATEKVCNTVGSKPGLPYVSGKDFIVQSYGYDPSHRWRGFGIALAYFIFFSAVYLLFCEYNESAVQKGEILVFPKAVLKKAKKEALSRPKSDVETGEDPEGGITDRKLLQDSQEDSNESVDEKQSAIALEKSGAIFHWRNVCYDVQIKKETRRILSNVDGWVKPGTLTALMGSSGAGKTTLLDCLASRVTMGVITGDMFVNGHLRDNSFPRSIGYCQQQDLHLSTATVRESLRFSAYLRQPSSVSIEDKNRYVEHVIRMLGMEKYADAVVGVTGEGLNVEQRKRLTIGVELAARPKLLLFLDEPTSGLDSQTAWSVCQLMRKLADHGQAILCTIHQPSALLMQEFDRLLFLQKGGKTVYFGDLGHGCQTMIDYFERNGAHKCPEGANPAEWMLEVIGAAPGSSTTVDYHEIWRNSEEYRMVQKELDWMEVELAKKPMDTTEEQKEFGTSLPYQFKIVTKRLFQQYWRTPSYIWSKVMLTVLPQILLGFTFFKAKLTLQGLQNQLFAIFTFTIVFSPACEQYLPMFVSQRDLYEARERPSRTFSWLAFIFSQFVVEIPFNVILGTVAFFVFYYPVGFYNNASYAGQLHERGVLFWLLCIEFYTYISSMGQLCMGGLEHDALAANIASIFFMISLLFSGVFGGPGVLPGFWNFMYRVSPLTYLMDGLISTGIANTKTQCAPYEFVHFSPREGQNCGTYMTPFIKSHGGYLQNPEDNSDCRFCRISESNTFLKNYKSDYREDGGTLVYFLCTSFSTGAAVCSCTG

SEQ ID NO: 89 - protein, 1220 aa, Hansenula polymorpha
MDEKDFYGSPVTITSVLDTSRVTKVSHKPWLFTFVKAKDCWLLLPALIFTILSAMVPATVAVLLARVFNKLEGFGRNDYSSSHDFVADVQWFCFAIAFVGIGATLFNWLGLTCFLLVGERQQKRCRQEVYQSLLRKELEWFDRKSDLNSNLMQVNRCIEEFRMGVSECLEMLIKSLAMLCALLILSFYYSWRLTLLVMATIPVIVLVTSGWGILIGKYTTLENKHSENTVKVLEWNLLNYMWIKIVDSSLLEKRKLDAATKLTSHSFLKMKLFFNLNAGMVKFLALMMFIQSFWYGSFLVRNHLNSSGDIISCFYSCLTVSRIFSTISSQIVSLKTAHISLKYVFKSVDCSNVSYEGGFQPKHVMMGNIKISNVSFKYPVRDDWGLKNITLQIPANHLLYIVGKSGSGKSTLASLILGLYHFDGKITCDDYDISRLDRSWLASQITLVQQQCTLFRGTIFENLSLASPTPVAPKLLNEALQITGLDQLIASLPGGLNTKLGGGPGSITLSGGQQQKVALCRAIIRDTPVLILDEALSAVDYNQRILILEKLKRNRRRRSTVIMTHDYSEIADSDYVVLMENGKIEEQGLKIDLLNGKTRFASLQYQLDTPDNPFEHGIEEEEVGERLDLLHDLESQAHKEVSILQLLRQLWHVLTFGSRVCFLLGIIVSVVNASMTPLFTFFLSKLILGIVSVGQQVSSTYMVKWSLVLLCVALMDGLSLFTSKMALSQSSETLVDQLRNRAFDKILVQPVCWFQSANPSALSSLLINDIKDLRTMISDAPSQLISVIALILIALVWSLIVCWKLALVGLSFAPLFAMFSILFSIVLQKYETEYKQASDNVEGVVYESVLGMKTVVSLNLQNHFQARFNNHMNQMNHAGKQRALIISIAMAAQNIAIYLSQAIMLYYGIKLVSEKSITLVQMMQVVALIMFTVGYVSAMLSSMPNVNKGVLVFMKILTLIQLPENLQESYGTAKPIMKPNKPLLKFQNVQFSYDPNSSPVLNNFNFSLYMNEITCIVGKSGCGKSTLLNLLLRLYSPQKGSIKFCGANLDQLDMSELKKEVAIVTQNHYFFDGTIFENLTYNLQKPVTSAQINEVLELVDMAKFVHSLPDNLFSRIGGSSNLLISGGQLQRLCIARALIRSPKVLILDECTASLDPQNTKRVAKIILGLKKHVTIIMISHQREMMQIADTVAYMEDGIIKEKGHYNTLSNRKNLFYQLIN

SEQ ID NO: 90 - protein, 1295 aa, Hansenula polymorpha
MSEKTSDITKSHSIEPLEYTPFNETGYEDTEENISFTKTHPVSINVHNLQISARKGPKKIFGRNAKKNSNESTKKQILHPMSFHIPENTLACIIGGSGSGKTTLLNRLAGKQITSSTLIQEGSVTYNNDSDLSKIRHAYVIQQDILIPNLTCFETLMFAAELKLPKLTSKTARAKLVNEIIMELGLKECRDTLVGDRVNKGLSGGEKRRLSVAIQLVSNPSLLFLDEPTTGLDSYNAYLLCESLKRLTKRLDKTIVLSIHQPRADIFRLFDQVYILSKGHMCYGDTYENVFNHFASLGYPIPENVNPADFLIDTTSIDSRNPEQEAISSKRVYFIVEQWKQRMAKIELPVYKDKNTDHGDETFQKVGRAPFWRELRILIRRNFILERRDPIGYAALLMEAILLGLMTGWLYFKPGSSLVGLRSIQGSLYTVSSLQAYLFLLYESYRLCSLDLRVYDRERSEHCISIPGFLLARRIAKLFSEDIIIPLLFSLCTYFMVGLRTDSSIYFFRFFAANILFHLNSMAFATLAASLTRDVALATLICNLNFTFQTMTNGMYVNAKQMPVYVRWCKYVAYQWYSYGLLISNQFTGYRGDCFKEHADSPNVEDICRAYTGSYITNSLGFWENWIALPFGVLVAFFVGTFVVAGVILKIKPEDVTMAKEVKQSESKSATSTEIPRALPQSDQPLDIRVCDVNLYVENKLARRGKKQILNNVSCNFQSGKLNIIMGPSGSGKTSLLNLMSGRLKSTLFTRYSSSGVVYLNDCQTEFDTIRPICSYVVQDDHHLLPSITVRETLRFSARMRLSKAKLSSSQINALVDRLILQVGLRDCADTLVGNELIKGISGGEKRRLSIAIQLLSSPKMLILDEPTSGLDSFTASSILECLDHLASSGTTVIMTIHQPRTLEGFGRILLLAKGGQVAFNGTQEELVDHFTSIGYPIPKFTNLADYVIDMISYSTTHEEVERRTRERVRHIVGAWKTENLHLIPRRKLTSKTDLYSEFHAFVKQPVDFVTGLYVLTQRQILSLIRDKNILFARCTQVIGMGVILSLFFARLKHNNTSIQNRLGLIQQIVSIYFTGMLNNMAAYPRERDFFYEEYTDDATNLYSFFVSYTLIEIPFEIFNALVFSVFLVFVVGFQYDVGLFFTMVYTSALVINAGESVGLSFNTMFDHPGFALNVISIICSVGVAMAGLLAMTLDSFLRALNYLSPAHYCVMSISNLVFTKKLKLYCTDEERVNNGQCLFNTGEDVMESYNLKVNLKLYLILIVIVTICHRLIPLVLLRLKLVKFSVMRPGHSSS

SEQ ID NO: 91 - protein, 844 aa, Kluyveromyces marxianus
MTDISVRTKVLKLLVQLHYQFLKLDLRKVQLKGYVPALLRHCWTLLRSADVSDSRNRGFKRHARFVIWAFAAICGGSGISLAIAVNRVIKICTRRRTRNLVSSSAKNQNLQNGTRELYIKEDGGKEKKVLVVPTDSDQYEHDRYLFKNLGNNVESQLFSSKFLQQLNVLSPILIPKFLHKNSLLLASQIFFLILRTWLSLMVARLDGQIVKDIISRRPKRFAYDMTCWLLIAFPASYTNSAIKYIQRKLSLNFRLRLTRYIHDMYLDKRLVFYKTSFDHEATNSIIRNIDNSITNDVQKFCDAITNVFANIAKPMIDLIFFSIFLRDSLGTLGVAGIFFNYFSTGYILRKYSPPLGKFVSLKSKSEGDYYNYNLNMINNSEEIAFYQGTEVEHSKVNELYDKLMDHMLLVDRSKVEYNIVEDYILKYTWSAWGYAFASIPIVIQTWASDAVNESGNMKEFIMNKRLMLSLADAGTRLMHSIKDISQLTGYTNRIFTLLKVLHRVHDSNFDYGVLHDGEEPSAAELNSIIGNGVTKSSPAIRGTVQHDFGGIRFENIDIIVPSSKGVNGSLLVKSLTFQIPQEIAPEPASSKQISLTNIRDPFDASKLINQRGMGSSLLILGPNSCGKSSIERILTEIWPIYNKNGLLSVPPAHDLFCVPQRPYFTQGSTFRDQIIYPMSYEEFYEKGFKDSYLKQILREVRLDYLLKRDRGLNYFDAVTDWKDILSGGEKQRVNFARIMFHRPRFVVLDEATNAISTDMEDHLFTMLKRYRFNFISISQRPSLIKYHDYLLELTSGTNWNLQTLGSDEAILTIEHEIDSIQQKLSNVKSSEKQRDEIQRKLNMM

SEQ ID NO: 92 - protein, 1025 aa, Hansenula polymorpha
MLRNLLLALCLVGPLGAFSRNSDFSTFIKGDWQQLQDNMLDQLATNAIGDSAPDKDDKCPPCFNCNLPNFECKQFSKCNPFSGRCECLDGFGGDDCSVPLCGALPDGSNRPKREVNETCHCEEGWGGINCNLCQIDSVCDAFVPGGLKGTCYHSGILVNRNFQMCDVTNSKILEVLNGKKPQVTFSCNKTAEKCNFQFWIAEEESFYCDLSKCKFNYDLGANTTHYNCEDVACKCLPGKMLCGQAGSIDISDFLTETIAGPADFSCDVAHKDCKFSEPSMNDLITNVFGDPYITLHCESGECLHESEIPGSDQPGKPKFGVIDVLRIIGTIVGCAAIIGLGFYGIKRSPLFMDEGTVQLPPDDNPDLQDSLLDDYKPAIFSFENVSYTVAGKKVLNNAFGLVEPGECMAIMGGSGAGKTTLLDIIAGKNKGGEASGTFYVNGERITTKQDLMHFQKSVGFVNQEDFLIPTLSVYETVLNSALLRLPKNMSMATKKAKVNQILAELRILHIKDKLIGSDFERGISGGEKRRVAIACELVTSPSILFLDEPTSGLDGYNAFNVVECLVRLAKDYNRTVIFTIHQPRSNIVALFDKLMLLSEGQLVYSGLMSDCSNFFAGNGYVCPAGYNIADYLIDITSGGSPIAMLSPVDGENHEHDIHTLLPANDVDDPTGEWQHYASHRDEFGNRVKSAGATSKASSAAVASIFEQSLNAERLHLDIKELAEKFNNAQQDNNSAGSFFKSQGGKTRAGFWTQLTILCSRTFKNSYRNPKLLMSHYALALIMGLFCSYLYYDVENNISGFQNRLGLFFFLLTLFGFSTLTGLHSFSVERLVFVRERSNNYYHPLSYYVSKLLCDVIPLRLFPPVILMAIIYPLVGLNMEGNKFWLSMLILVLFNLAASLEILIIGILVKEPGSATMVGVLVLLFSLLFAGLFINKDTIPVQISWFENISVFHYGYEALAVNEVNGLVLKEKKYGLDINVPGAVILSTFGFDVGAVGFDICWLAGMFGAFVVLGYLGLHYFVYETR

SEQ ID NO: 93 - protein, 695 aa, Saccharomyces cerevisiae
MAGILSKTLSEVHPSLRTNGMGIGNTHRRISLGFLPPNKKNPLVRKFRARTRNIDQRSFRSLTDDFGSNVHEPNPYLGNIDEEPDLYYHDEEDGELSRTISLPSRVSETPELSPQDVDWILHEHERRYSSVCNSDNEEASQSNTPDRIQEYSGRELEYDEFMNRLQAQKQKLTRSAVTDAKGTSHHRRPSFVSVTSRGSVPTIYQEIDENDSEALAELAHSHVTFKSEARVLASYSFPLIFTFLLEQIFPMVCSLTVGHLGKNELAAVSLASMTSNITLAIFEGIATSLDTLCPQAYGSGRFYSVGVHLQRCIAFSLVIYIPFAVMWWYSEPLLSYIIPEKELINLTSRFLRVLILGAPAYIFFENLKRFLQAQGIFDAGIYVLTICAPLNVLVSYTLVWNKYIGVGFIGAAIAVVLNFWLMFFLLLFYALYIDGRKCWGGFSRKAFTHWNDLGHLAFSGIIMLEAEELSYELLTLFSAYYGVSYLAAQSAVSTMAALLYMIPFAIGISTSTRIANFIGAKRTDFAHISSQVGLSFSFIAGFINCCILVFGRNLIANIYSKDPEVIKLIAQVLPLVGIVQNFDSLNAVAGSCLRGQGMQSLGSIVNLMAYYLFGIPLALILSWFFDMKLYGLWIGIGSAMLLIGLVEAYYVLFPDWDKIMTYAEILKETEDDEVDSDEYLTDSDDPDENTALLGA

SEQ ID NO: 94 - protein, 486 aa, Saccharomyces cerevisiae
MNRILSSASLLSNVSMPRQNKHKITKALCYAIIVASIGSIQFGYHLSELNAPQQVLSCSEFDIPMEGYPYDRTWLGKRGYKQCIPLNDEQIGIVTSVFCIGGILGSYFATSLANIYGRKFSSLINCTLNIVGSLIIFNSNSYRGLIIGRILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 95 - protein, 736 aa, Yarrowia lipolytica
MDRLKTSAVGQKVVSYVSARSPVWGATYLRHRSKILWSIYMVLFLSNFAGVGSKRSKKKARKEEKEEERKAEREVLGSANAIPEKKVKSEINREFFLKFKRVIKVMFPNGLRSKEFWLLCLHTMFLIMRSVISLYVANLDGKLVSDLVRGKGRAFLWGIVWWMVVSVPATFTNSILSYLQCILALRYRNNLTQHIVGEYLPESGNPVYYSIHNLDDRIKNADQLIAVDVQRLSHSVSHLYSNLAKPTLDMFLYSWSLSRNLGGEGMLLVGFLIQGSAVVMRALTPPFGRYAATEAALEGEFRFEHTRLIEYAEEVALYNGQEHEKTILDKGYFALIKHKNRILVRRLYHSFMEDFIIKYFWGALGLALCSIPIFFKVPGVDVASAAASGSRTEKFVTNRRMLLSCSDAFGRIMFSYKEIAQLSGYTARVVALMDVMEDIKHGNFDKNQISGKQVDARHEKTLASVTESSLVKTRYSDPSEASGKTIIGSDIIFDRVPVVSPSGDVLVPELSFEVKYGRHLLIVGPNGCGKSSLFRILGGLWPVYAGTLTKPPSSDIFYIPQRPYLSRGTLRQQVIYPSTEAENKTSDKELEEILKIVKIDHIVEAVGGWDAEREWREDLSMGVQQRIAMARLFYHKPKFAILDECTSSVTADMEYVMYTHSQELGISLLSVSHRTSLWKYHDLILQFDGQGGYLFGDLDPEERLKVEEESRQLDAYIRSVPDMEERLAMLKASVAQ

SEQ ID NO: 96 - protein, 1361 aa, Hansenula polymorpha
MNTEQAFEKHLALQRRPLTFLLSKNVPPLPLQEERKTFPHYKTNPLYRCFFWYLTPLLRVGYKRTLQPEDLFVLDEQQTIDYMYTKFKSTFEPEVEKLLAQHIARKCQERGETPETSSVSPEEDADDFEIKVSVLGKHLFYTFGWQYSRAAFVKVLADIAGTLMPLLQKKLVDFVETRGYGASTNTGKGVGYAIGACAMILFSGICINHYFYNSITTGAKVKAVLTKALLEKSFKLDARGKHRFPVGKINSIMGTDLARVDLAIGFFPFLFIFPIPVIIVVVMLIVNIGVSALAGIAVFVFFTLFTGFLIRYLFKLRVSANVFTDQRVNLIKELLKNFKMIKLYGWENSYLRSFQKIRSQEMSTLFKMQGGKNVLIGISLWMPLAASMVAFLVLHSLKSSRSVGDIFSSLTLFQVLTQQFLLVPASLAMSSDMVIGLKRVCQLLSCPEDKELDKFFDDLDDEKLAMKIENASFQWHTFEDDETEDKNESVKSTKSTKSSTMSEEQEVVEKESHEREELSKTDFPGLLNLNLSIKKGDFVVVTGSVGSGKSSLLNALCGFMPKTEGRVCKNGSVMLCGAPWVQNATVKDNITFGRPFDQEKYDSVVKVCSLKGDFDQLPGGELTEVGERGITLSGGQKARINLARAVYADRDIIMLDDVLSAVDAKVGKFIMDECILGYLRDKTRILATHQLSLIGSADKIMFLNGDGSVDCGTFAELRSRNTEFVRLMEFSHDVEKDDDEETLENEKKGFFDDEDKGKLVQAEEKAVNAISWQVYKSYINTGSGKLRALLPMLFFLVIALTTFLTLFTNNWLSFWIVDRFHRPKKFYEGIYIMFTMLVMVFNVLQFMILVYFCNRAALRLNIMAFKRVLHAPMSFMDTSPMGRVLNRFTKDTDALDNEIQDQLRMFLNPAATIIGTLVLCIIYLPWFAIAIPFLAMLFFLVSSFYLSSSREVKRLEAVKRSVVYSHFNEALSGMDTIKAHGSTERFLKVNEKLIDDMNESYYVVVAIQGWLAISLDSVATLLCLIVALLCCFRVFNISGAYTGLLLTYVLTIAGLLSFMLRSLTEVENQMNSVERVNYYATSIKQEAPFEIPENDPEPSWPAVGAVKFIDVSMRYREELPLAVKHLDINVRGGEKIGICGRTGAGKSSIMYCLFRLAEFEGQILIDGVDISRIGLHKLRSRLSIIPQDPVLFSGTVRSNLDPFGEHDDETLWTSLGKAGLIDRDLLPQVKEQSKGDPNLHKFHLSRTVEDDGSNFSLGEKQLIALARALVRGTKILVLDEATSSVDYETDAKVQTTITKEFSDCTVLCIAHRLKTIVKYDRILVMDKGQIAEFDTPRKLYDQKGIFRSMCNKSGVSEADLK

SEQ ID NO: 97 - protein, 1333 aa, Saccharomyces cerevisiae
MECVSVEGTATSFLEGQTFGDILCLPWTIIKGIRERKNRNKMKIILKNVSLLAKSGEMVLVLGRPGAGCTSFLKSAAGETSQFAGGVTTGHISYDGIPQKEMMQHYKPDVIYNGEQDVHFPHLTVKQTLDFAISCKMPAKRVNNVTKEEYITANREFYAKIFGLTHTFDTKVGNDFISGVSGGERKRVSIAEALAAKGSIYCWDNATRGLDSSTALEFARAIRTMTNLLGTTALVTVYQASENIYETFDKVTVLYAGRQIFCGKTTEAKDYFENMGYLCPPRQSTAEYLTAITDPNGLHEIKPGFEYQVPHTADEFEKYWLDSPEYARLKGEIQKYKHEVNTEWTKKTYNESMAQEKSKGTRKKSYYTVSYWEQIRLCTIRGFLRIYGDKSYTVINTCAAIAQAFITGSLFYQAPSSTLGAFSRSGVLFFSLLYYSLMGLANISFEHRPILQKHKVYSLYHPSAEALASTISSFPFRMIGLTFFIIILYFLAGLHRSAGAFFTMYLLLTMCSEAITSLFQMVSSLCDTLSQANSIAGVVMLSIAMYSTYMIQLPSMHPWFKWISYILPIRYAFESMLNAEFHGRHMDCGGTLVPSGPGFENILPENQVCAFVGSRPGQSWVLGDDYLRAQYQYEYKNTWRNFGIMWCFLIGYIVLRAVFTEYKSPVKSGGDALVVKKGTKNAIQRSWSSKNDEENLNASIATQDMKEIASSNDDSTSADFEGLESTGVFIWKNVSFTIPHSSGQRKLLDSVSGYCVPGTLTALIGESGAGKTTLLNTLAQRNVGTITGDMLVDGLPMDASFKRRTGYVQQQDLHVAELTVKESLQFSARMRRPQSIPDAEKMEYVEKIISILEMQEFSEALVGEIGYGLNVEQRKKLSIGVELVGKPDLLLFLDEPTSGLDSQSAWAVVKMLKRLALAGQSILCTIHQPSATLFEQFDRLLLLGKGGQTIYFGEIGKNSSSVIKYFEKNGARKCQQNENPAEYILEAIGAGATASVQQNWPDIWQKSHEYANINEKINDMIKDLSSTTLHKTATRASKYATSYSYQFHHVLKRSSLTFWRNLNYIMAKMMLLMISGLFIGFTFFHVGVNAIGLQNSLFACFMAIVISAPATNQIQERATVAKELYEVRESKSNMFHWSLLLITHYLNELPYHLLFSTIFFVSSYFPLGVFTEASRSSVFYLNYAILFQLYYIGLALMILYMSPNLQSANVIVGFILSFLLSFCGAVQPASLMPGFWTFMWKLSPYTYFLQNLVGLLMHDKPVRCSKKELSLFNPPVGQTCGEFTKPFFEFGTGYIANPDATADCAYCQYKVGDEYLARINASFSYLWRNFGFI

SEQ ID NO: 98 - protein, 1503 aa, Pichia pastoris
MSSTSSSINDKDKESSNIDSPKDTVPYEPTRFVGDLENQNEDDIYSEQLSRILTQSEAVQKIQSLARTMSRMTKKELAAFEVNQDDFDLKILLHYLRAKSEEQGIESCSAGVAFKNLTATGIDVSAAYGPTVDEMLRNFFMWPIRFAKREHVKTRQIIRNFTGSIEAGELCLVLGRPGAGCSTLLKCCTGNTSELLSVEGEFSYDGLDQAEMMKDYKGYVIYNPELDTHFPHITVKQTIDFALKMKTPAKRVDGIPRKKYIDTMRDLWCTVFGLRHTYGTKVGNDFIRGVSGGERKRVSIVEALATGASVYAWDNATRGLDASTALEFTQAIRTSTNLLNASGMVAIYQAGENIYELFDKVCVLYNGKQVYFGPAEKARKYFEDMGWYKPPRMTTPEFLTAVTDPSGRFIREGFKNKVPENSEDFEQYWLNSPEYQECLRSHDQYIQDHNPEETRQRLATAKSQTRQKAVRSKSRFVASYPNQIAYCVTRGFQRTKGEIAYTLVYLSSFLTKGFIVGSMYWNIPKDTSGLFSRSGILFYCLLFCAVTSLSEISHTYTNRPIILKQKSYSLYHQSAESLQEIITELPTKLVAVIILALTTYFMPGLRLSDGGSAFWMYLLFLLLIQQCMSFMFKLIATLTRDAGTAHACGGLLALMMCVYTGFIIPLPYMHHWIKWFNWINPMRYCYESLLATELHSREMKCSEYIPNGPDYEGISMENSACTTTAYNHTTGLVSGNAFLTATYNYRYSHVWRNFGINIAWTAGFIIINTILSEFVKNVEGGGDMLLYKRGHMPKEGIEAVDGKVASKQEMMEALNGPDVDLKKVIAERDVFTWQHLDYVIPYGGATRQLLNDVQGYVKPGTMTALMGESGAGKTTLLNTLSQRINFGTITGDIFVNGRPLDSSFKRRTGFVQQSDLHLAEYSVRESLRFAVNLRQSEKVPQAEKYEYVEKIINLLGMQNYAEAIIGKIGRGLNVEQRKKLSIAVELVAKPSLLLFLDEPTSGLDSQSAWSIIQFLRALSDSGQAILCTIHQPSATLFEVFDRLLLLKKGGRTVYFGDIGPNSSTMLSYFERESGIKCGVSENPAEYILNCIGAGATAHASADWGDLWVSSPEHAAVTEEISRLNTELQKRPLPENIEDLQSKFATSYPHQIKILFLRTMVQFWRSPVYIRAKFLEAVVCAIFVGFSFVKVGHGLQEAQFGLTSIFMMLIISLAMINQMHVFAFDSRELFEARESASNTFHWSTLLLAQTWWETIWCMACQFLCFVCYYFPAGFSGTAHHAGYFFLQFVIIFPIYYCSYGLWVLYFSPDVPSAGMINSNFFAAMLLFCGVLQPPQFMPGFWTFMYKLSPYTYFVQSFVAPLVHNRKLVCRTNEYTLITPPEGQTCSEFLDPFIESDGGYLGNPDATESCEYCPYTYQSQVMEQFNIKWSYRWRNFGFFFAYIIFNYVALLSCYYLMRVKVWNMKSILNFKKWFNGPRKERHDPETNIFAAQPADAKLAVLKKKE

SEQ ID NO: 99 - protein, 1460 aa, Vanderwaltozyma polyspora; identical to SEQ ID NO: 29

SEQ ID NO: 100 - protein, 649 aa, Yarrowia lipolytica
MDRLKTSAVGQKVVSYVSARSPVWGATYLRHRSKILWSIYMVLFLSNFAGVGSKRSKKKARKEEKEEERKAEREVLGSANAIPEKKVKSEINREFFLKFKRVIKVMFPNGLRSKEFWLLCLHTMFLIMRSVISLYVANLDGKLVSDLVRGKGRAFLWGIVWWMVVSVPATFTNSILSYLQCILALRYRNNLTQHIVGEYLPESGNPVYYSIHNLDDRIKNADQLIAVDVQRLSHSVSHLYSNLAKPTLDMFLYSWSLSRNLGGEGMLLVGFLIQGSAVVMRALTPPFGRYAATEAALEGEFRFEHTRLIEYAEEVALYNGQEHEKTILDKGYFALIKHKNRILVRRLYHSFMEDFIIKYFWGALGLALCSIPIFFKVPGVDVASAAASGSRTEKFVTNRRMLLSCSDAFGRIMFSYKEIAQLSGYTARVVALMDVMEDIKHGNFDKNQISGKQVDARHEKTLASVTESSLVKTRYSDPSEASGKTIIGSDIIFDRVPVVSPSGDVLVPELSFEVKYGRHLLIVGPNGCGKSSLFRILGGLWPVYAGTLTKPPSSDIFYIPQRPYLSRGTLRQQVIYPSTEAENKTSDKELEEILKIVKIDHIVEAVGGWDAEREWREDLSMGVQQRIAMARLFYHKPKFAILDECTSSV

SEQ ID NO: 101 - protein, 690 aa, Saccharomyces cerevisiae
MLLLPRCPVIGRIVRSKFRSGLIRNHSPVIFTVSKLSTQRPLLFNSAVNLWNQAQKDITHKKSVEQSSSAPKVKTQVKKTSKAPTLSELKILKDLFRYIWPKGNNKVRIRVLIALGLLISAKILNVQVPFFFKQTIDSMNIAWDDPTVALPAAIGLTILCYGVARFGSVLFGELRNAVFAKVAQNAIRTVSLQTFQHLMKLDLGWHLSRQTGGLTRAMDRGTKGISQVLTAMVFHIIPISFEISVVCGILTYQFGASFAAITFSTMLLYSIFTIKTTAWRTHFRRDANKADNKAASVALDSLINFEAVKYFNNEKYLADKYNGSLMNYRDSQIKVSQSLAFLNSGQNLIFTTALTAMMYMGCTGVIGGNLTVGDLVLINQLVFQLSVPLNFLGSVYRDLKQSLIDMETLFKLRKNEVKIKNAERPLMLPENVPYDITFENVTFGYHPDRKILKNASFTIPAGWKTAIVGSSGSGKSTILKLVFRFYDPESGRILINGRDIKEYDIDALRKVIGVVPQDTPLFNDTIWENVKFGRIDATDEEVITVVEKAQLAPLIKKLPQGFDTIVGERGLMISGGEKQRLAIARVLLKNARIMFFDEATSALDTHTEQALLRTIRDNFTSGSRTSVYIAHRLRTIADADKIIVLDNGRVREEGKHLELLAMPGSLYRELWTIQEDLDHLENELKDQQEL

SEQ ID NO: 102 - protein, 1423 aa, Scheffersomyces stipitis; identical to SEQ ID NO: 33

SEQ ID NO: 103 - protein, 1716 aa, Candida pseudohaemulonii; identical to SEQ ID NO: 7

SEQ ID NO: 104 - protein, 1400 aa, Candida tanzawaensis
MSDNEAAQLHSQKRLLTKFLSKRIPHLPSPDERPPYPSSTANVFSKVFFWWLHPVMRTGYKRTLEPEDLFTLTDDIKVEKMAADFYRHFTAGVAKAETKHIAAKCKARGETPATSSVSSADDLADFTVSKYVTVWALFLTFKWQYSMSCLFLSLSSVGQTTNPLLTKKLITFVERRALGIETSINKGLGYSFGSCLVIMMVGIFINHFFYRSMLTGAQAKAVLTKAMLDKAFRLNAESKHKYSVGKITSIMGADLARVDFAFGFQPFLFTFPIPVAIAIAILVVNIGVAALVGVALVVLFLVFIFTLAKRLFGLRFKAMKFTDLRVNYLKEALNNLKVIKYYSWEAPYEANIADARHKEMKIIYKMQVMRNILIAVAMSLTLFSSMIAFLVLYAIRTGNRSPADIFSSISLFNVLSQQVILLPMALSSGTDALLGITRVGEFLCADELDPEELRIEADGPKREQMEKENLALEVQNASFEWETFDLDDNAEEANEKKQEKVAKTDSSDKDEKYESESDASSEIVFSGLHNIDLKIQKNEFVVITGLIGSGKSSLLSALSGFMKRTQGAIDVNGSLLLCGYPWVQNATVKENIIFGNEYDEQRYKDTIYACSLEADLDVLPGGDATEIGERGITLSGGQKARINLARAVYADKDIILLDDVLSAVDASVGKHIMNNCLLGMLKDKTRILATHQLSLISAANRVIFLNGDGSVDIGTTSELKERNPGFEKLMAFSSEQKDEEEDEENIEEELDVIEGAPKKSKKENRADEEAIHKTYKNDTTGGKLTEEEERAVNGIKFEVYANYANEGSGKVGPWVVVPSYLLLMILATFCQLFTNTWLSFWTEYKFKDKPDKFYIGIYVMFTVLSFVFLLSEFIVLVSLSNSAAINLNIRAVKRILHAPMSFMDTTPMGRILNRFTKDTDVLDNELGDQARFLMFTLSNIIGVLILCVIYLPWFAIALPFLGFLFVAVANFYQASAREIKRLEAIQRSFVYNNFNETLSGMPTIKAYNAEARFVAKSDNYLNVMNEAYYLSIANQRWLTLHMDILAAIFALLICLLCVGRVFSISPASVGLLLAYVIQIANQLSLLIRTFTQVENEMNSVERLSQYAFGLPEEAPYVITETTPKESWPEQGEITFKDVSMAYRPGLPLVLKDLSFQVKPAEKIGICGRTGAGKSSIMTALYRLTELEKGSIVIDGVDISNLGLHALRSKLSIIPQDPVLFRGSIRKNLDPFNERSDDKLWDALRRTGLIDSTRLEAVKKQVKTDDTDDESAMHKFHLDQSVEDDGSNFSLGERQLIAFARALVRDSKILILDEATSSVDYETDSKIQETIIREFSQCTILCIAHRLKTIINYNRILVLDKGELQEYDTPINLFNTDGSIFQQMCERSNITEEDFKDVQNF

SEQ ID NO: 105 - protein, 1374 aa, Metschnikowia bicspidata; identical to SEQ ID NO: 19

SEQ ID NO: 106 - protein, 1410 aa, Clavispora lusitaniae; identical to SEQ ID NO: 20

SEQ ID NO: 107 - protein, 1453 aa, Kluyveromyces marxianus; identical to SEQ ID NO: 28

SEQ ID NO: 108 - protein, 1409 aa, Pachysolen tannophilus
MSARDIEKQDLLESLKAQKRFLSVFFPKEIPPLPSEAERNPYPASDVNIFSRIFFYWLNKLYVKGYRRTLEPADLWYLANDYEVNHYFERFNSHYQLSLKKKSENYALINESIYQQDDVLDESSKERSKKLTSLHTNIVVLCVFKTFAKEIVLVWLCFLFAMFSSAGAAIFSKYLILFVESTTSSIGAGVGYAIGTSICTWLLSVGENQFFYNAQVLSYKVSSILIKLTMTKALKLDARGRFKYPSSKISSIIGGDLSRIQDGCLYFIALLGVPLPLILFIGILIWNIGVSSLAGIGVFLLLIGCTSSFATKLFSLRSDINIWSDKRLSYIKEILNNFRIIKYYTWENYYFKKIYDVRKKEMNYVFTSQFIRTVMISIIISSTYLSTMISFLVLYYSKSSKRNVANIFSSISMFNILSTLIAAFPFFVSSSTDAYAGLKRFGELFSCGESDENLLLKYNDIEDDLEFEDENFKMRKGSNEPAIKIENASFEWETFEIDDDDVDVENEKEEKKTKKNKKKCKKNNENENKNQESKISKSKDFSLIDLNLSIDRGEFIIVTGVVASGKSSLLNAMSGFMKCIEGSIEVNDSILLCGESWVQNATIKDNILFGKEYDKKKYKEVLYACDLTADLKNFPAGDNTEIGERGITLSGGQKARLSLARACFDSKNIILMDDVLSAVDAKVGKHIMENCILGYLKDKTRILATHQLSLVGAADRVIFLNGDGTIDVGTSQELLETNEGFISLMQHATDNNNEDSIVEAEEVEAGKDESQDLLRIRSTKLMVTTSIQSIDDNESKCIGKLVEVEERAVNSIQYDVYRNYVKLGSGIFGVFFLPVLFVILSLGIFASIFQTVWLSYWTEYRFSSLTNNEYVGIYIAINIATIIFVLCINTLLVYISNNAGRLLTVKGVERLLHAPTSFMDSTPMGRILNRFTKDTNCVDIELSEYLRLFVTPVGLVVGTVILSIVYIPWVAVAVPFFAFIFFCITNYYQASSREIKRLEAVQTSFVFSHFNETLNGMNTVKAYKAEKRFKSKNDFYINQRNEALFLTTANNSWIKISLGTFSSLFILFVSLLCVSGVFSLGAGATGVLLSNLLNIADQLTTALVQFTNLENSMNSVERLYHYAFKLPQEAAYEIRETQPSPQWLTVNSNIEFRNVFMQYSKNSPFVLNRLNFEIGTGEKVGICGRTGAGKSSIMTALYRLCEITEGEIIIDQVDISKIGLETLRSHLAIIPQDPIMFSSTLRKNLDPFDKFSDDKLYDVLKIVTLVDDIEKVKRQDGYHGETLHKYNLNQSVSEAGSNYSLGERQLVSLARAILHDSKILIMDEATSSVDYDTDEKVQRIIKQQFSHCTILCIAHRLKTIIDYDRILVLEKGEVIEFDTPYNLFCTEDGVFKEMCEKSRIVESDFNKVN

SEQ ID NO: 109 - protein, 1457 aa, Kerivoula Africana; identical to SEQ ID NO: 37

SEQ ID NO: 110 - protein, 1352 aa, Saccharomyces cerevisiae
MSEACKLEAIDAVDASSSAGSVDSQYYNELQQKIQVKKGWPLLKLLVGKEPQPITPSDKKYPYYTANLWSLLTFAWAFEIIKKGYLRRVEDEDMYELPDNIKIKAMTELFEDNFRKRREAFSLKYGDDVPFTKWVVIRALNDTFFKEFWLIAGTAKVVMDLAQVLSPLLVRQLVRYIQLKSSHDPGVGNAIGYSIGISAMIMLTSVSLSHFFHSSMVVGGCVKAVLTNVIYKKAFNVSSKVRFQYPNGKINSLVMADLARIDLAVGVFHFIWAFPLSLSIATIVLCCYLGAVALIGIATVVLFLVSIFWFNAKLKQLRIKANVFIDKRVRAINEIINNMKMIKLYSWEIPYKERLAEYRGVEKEFIFKVQMLKSIMNSGINSITGIATMLTFIALFYLSGSHFQSYNVFSAVTLFNMIRMPINLLPMATSFATDALIAMDRVTGFLQAEDDELTVSRLPVEGSTNAIEIHDATYQWDIEPRDDLITSVTSETLEKDLSFPGLRNINLTIKRGDLIIITGSIGTGKSSLLNAIEGTMRQESGDAKVYGSLTFCSYPWVQNATIKENILFGMPYNREKYHSVVSACGLDVDFKALPGGDQVEVGERGITLSGGQKARINLARAVYADRDIILLDDVLSAVDATVGKHIMKECICGLLKDKTRLLATHQLSLIDAADRIIILDGTGSLQIGTQSELLQTSPTFSNLMNFSRQPEEQEREKEEDVMIDDEEEKELQRVQTQISTAKKEKAESREEQRSMESISIKVYLNYLALGSRLFGRFIIPIFFLTIAVSGFLQLFFSVWLSFWLSDRFGYSSQLYTGLYVLLVMLSTLAFVCLFTLMASLNNTAGLRLFNMSSSKLLKTPMWFMDITPIGRILNRFTKDVDVLDTDLIEQLRLFVTSSSTVCCTIILCACYIPWFLIAVPVALFIYVHLFIFYKSSALDIKRLESVNRSLVFSLFNESLNGMKVIKSYSSVERFQHRFESLINKMNSAYFLTFANQRWLSIRLDCIGSLLTLFICIMCVCDVFHLSGSSSGLLVSYIIQVSSLMSLLLRSMTMVENDMNSVERLFEYAMDLPEEGPFEIEETKPRESWPEKGAIAFNNVSLSYRENLPLVLKNVSFDVKPGEKIGVCGRTGAGKSTIMNALFRVSPVREGFITIDGVDTSTIGLSDLRSKLSIIPQDPVLFHGTIRENLDPFGSSSDAELWDALRKSWLVEDGARGTGSYKIGETNITTLHKFHLDQLVEDDGANFSLGERQLLALARALVRDSKVLILDEATSSVDYETDVKIQSTIANDFAHCTILCIAHRLRTILNYDRILVLDKGQVVEFDTPLNLFKLGGIFSGMCQRSGITEREFP

SEQ ID NO: 111 - protein, 1510 aa, Saccharomyces cerevisiae
MGDHTGDDNSSVESVGRYQGFDSQVEGQIQDLVRTLTQKSEAAFQEGQNESDGESVLSRALSRVSTIAPGVNPMGEDLEELDPRLNPDNPDFSSRYWIKNIRAFMDKDEAHYQNYSFGIAYKNLRASGEATDADYQTTTLNAPYKFAKMYAKQLFTTKAQKAKSQFDILKPMDGLIKPGEVVVVLGRPGSGCTTLLKSIASNTHGFEIGEESKISYEGLSPNEIKKHFRGDVVYNAESDIHFPHLTVWQTLYTAAKFRTPQNRIPGVSREDFATAMTNVYMATYGLLHTKNTKVGSELVRGVSGGERKRVSIAEVSLAGAKLQCWDNATRGLDAATALEFIRALRTSADVLDTTAIIAIYQCSQDAYDLFDKVSVLYDGYQIFFGRADEAKEYFIKMGWECPQRQTTADFLTSVTSPRERIPRKGYEDKVPRTAKEFEAYWKASQEYSFLVKEIDATISQNEQTNQSSEYYASKHARQSNHMRKSSPYTVSFFMQTRYLLTREFQRIRNDIGFHAFSVLSNSLMALVLSSIFYNLPSTTSSFYYRGASMFFAVLFNGFQSFLEIMSLFEARPIVEKHKGYGLYHPAADALASVTSQLPFKLFTSLFFNLIYYFMVNFRREPGNFFFYLFVNILATLTMSHFFRLVGSMSSTLPQALVPAHVIMLAMILFTGFTIPINYMLGWCRWINYLDPMAYAFESLMVNEFHNRIFECSSYIPGNPADNPSWPSDSWVCNAVGASAGETYVNGTLYLKTSFRYSHGHKWRNVGILIVFMIGLLAAYTLFAEFNESAKQKGEILLFQSSTLRQLKKDKANNDIEAGKERDITEAPEEEDVNVDAIQAGKDIFHWRDVHYTVKIKSEYREILSGVDGWVKPGTLTALMGASGAGKTTLLDVLASRVTMGVVTGSMFVNGHLRDSSFQRSTGYVQQQDLHLETATVREALRFSAYLRQPSSVPKQEKNEYVEEVIKILDMQKYADAVVGVAGEGLNVEQRKRLSIGVELAAKPKLLLFFDEPTSGLDSQTAWSICQLMRKLANHGQAILCTIHQPSAILMQEFDRLLFLARGGRTIYFGDLGKNCQTLIDYFESHGSPKCPPEANPAEWMLHVIGAAPGSHANQDYHQVWLESDERKEVLKELDYMERELVKLPYDSTVGHREFATSIPYQFVVVLKRVLQLYWRTPSFTWAKLFLSISSCIFIGFVFFDADLTIQGLQNQMFALFMFLTIFNPMIQQQLPMFVSQRDLYEVRERPSKTFSWKAFMAAQIVADIPWNIVLGTIAYFVFYYPAGFYHNAEPTHQVNQRGAYAWFFSCLFFVFMGTFGSLCVAPLQLADSAGNVAMLCFTLCLTFCGVLVGPDALPGFWIFMYRVSPFTYYIDGFLSNALGNAQVTCSQAELRVLNPPDSNMTCSEYLGDYIEAAGTGYLVDGSATSECALCPMSSTNAFLRSVSCSYSRKWRNVGIFCAYIVINIVGALFFYWLARVPKKRNRVKDERPEATTSVGEGKEVESNLEKASSD

SEQ ID NO: 112 - protein, 650 aa, Saccharomyces cerevisiae
MFNNRAVKDIDNFITRDVDRFASSLAALFSNIGKPMMDLVFFAVYLRDNLGTAGITGIFVNYFTTAYILKCFTPPFGKLSKEKSSLEGEYYNDHLNLINNGEEIAFYNGTMLEKIKINKVYNNMMDHIFKINRIKVRYTFLEDYLLKYTWSALGYLYISIPIFLASLQDDVKRSTEDRNMRQFIVNKRLMLSMADAGSRLMYSLKDISKLTGYTDRVFTLLTVLHQVHAAEFNYGDESDVNTLRGTVQYHYNGLRFEKINVIIPSKNGHDGIKLIKELDFSLKSNQSILILGMNGCGKTSIERIIAGLWPLYDGLLSKPSEDDVIYLPQRPYFSTGTLRDQIIYPLSYADMLDRGVTDLDLVQILREVKLEYLLDRECGLSYLDSVQEWKDVLSGGEKQRVQFARILFKNPKFVILDEATNAISSDIEAYLFDLLKQKKFAFITLSHRPLLIKYHDYLLEIQENGDWIFETMGSDQAITSIEKEIKQIEEKLKDVAKLEGRKHTLELLLDGHEVNDTIVTASKMLESSVEVIQEIETEPATISNATSKPSAKPLPKPLAKPGANLGRASPMKASHPSKPNATTTSGGSPRPSKPSPKPSLSSLKRSPSIISNSSSKSSSSTSSSKPPSKPGRGLKNTLKKAVSKKPPTSK

SEQ ID NO: 113 - protein, 875 aa, Saccharomyces cerevisiae
MDNLILPHKLLSKRQLKWLAQLNIRWTSKPVLLFLTAVLSSVAGISAYNIAKLIQNIRNYLLKRSKNRPLQRGNRIAKQIEVPYKNSTISVDIPYPNYDRISVDNLVFKQYIKEEMLLKDSPGATSFWKAINSRFLNKLFIIWKLILIPKWLDKNSYLLVAQLSLLILRTYLTLLVTKLDGSIVKNLIGLQGKKFIRDIIYWFLLAVPASYTNSSIRYVTKRLSLSFRTNLLRYCHDLYMDNRLVFYKMQFNTNEMLPKEYQLDSKYIDQYLTDDIKQFTSTLASLFTNTGKPFMDLIFFAIYLRDNLGTAGIVGIFTNYFITCWFLRLKAPKFSKMLKKKANLEGIYYNYNLNLIYNAEEISFFKGIPLENRKIKSIFGDLQKQIFKEMVQRFHYGFWEDYILKYTWSCLGYLYSAIPILLAPTSKRTSNSSKNMKNFIVNKRLMLSMADAGSRLMYSIKDVSKLSGYTDRIFTLLLNLHQVHDSGFQYGLDLTNGQQTSLARLPSLRILSSFTNLNHLSSQNMKSLGFINGIIQTNYDGLRLENIPIIVPSPKGANGPKLIESLSFTIKKGNNLLIIGKNGCGKTAFMRCLAGLWPIYEGLLSKPLDSNIMYVPQRPYFLSAGTLRDQIIYPLSSETSKVDDELLIGLLKDVGLEYLFERFNSDLNFRPSIKNDNVTASNGTERDSGNISKNSWFSLLSGGERQKMIIARVLFHNKTYVVLDEPTNAISYDMEDYLFKLLKKRGLTIITISHRSSLEKYHDYCLELVSDLNEKVVELDDEKTSEMPITTHKWKFKNLREDSDDSDSLDDEISDYRHKIRDLYKNHRNTDSEGSSVEDRNELAKEEIKILKNELSKLEELEKRKLEVLNYLDNE

SEQ ID NO: 114 - protein, 1289 aa, Saccharomyces cerevisiae
MRLFKRKKDPEKEHLDEKDAQFKNPDDQLNEKFDQLDPATREVLEGQLKGVSFKASLADLYGLLRGWEYLIAFIAYVCSIIAGAALPLMTLVVGDMAQQFTNYFTGVLGRSEFEDKIRDNSLYFVYLGIGLTVFQYLATFLHIVISEIIASRVRQKFVWSILHQNVAFLDSMGSGEITESITSDTRLIQEGVSEKIGMTVECLATVVSALVVAFAKYWKLALVLLSVMVGLIMSATPTTLMLIKMYMKSLESYGKASSIAEETFSAIRTATAFGAHEFQLSRYNIFILESRGYGFKKALWLSLMIGSVWFIVFNTYALAFWQGSRFMVSDNSGIGKILTACMAMLFGAMTIGNVTTHMKDVSVGIGAASKLLAVINREPYLDSSSEDGSKLERVDGSISFRNVTTRYPSRPDITVLSDFTLDVKPGNTVALVGESGSGKSTVIGLLERFYEYLDGDILLDGVSVKDLNIKWLRQQIALVQQEPVLFAASIYENICYGLVGTKYEDAPEEVKRDLVEKACKDANAWEFITQMSHGLDTEVGERGLSLSGGQKQRIAIARAVISQPKILLLDEATSALDTKSEGIVQDALNRLSESRTTLVIAHRLSTIQNADLIVVMSNGRIIERGTHQELIKLRGRYYQLVQVQNINTKINSTQVTKSIAASTISDSENDKPNDSESLIYEPSPEIASDLPPQKKPSVGQLFLMLLKISKGEYHLIIPAMFCALIAGMGFPGLSLLMGHIVEAFQVSGPDEYPHMRSQINKLTGYLFMIGVIEFINYIFLISSLVMASEYLIYKMRYRCFKQYLRQDMAFYDQPQNKVGSLVTMLAKDPQEIEGLSGGTAAQITVSVIIVVVGIIISLITNWRLGLVCTSTVPLLLGCGFFRVYLIIMFEERSLKSYQGSASYACEQVSALRTVISLTREKGIYDKYSKSIKAQVRRSTQSVAKTAIMHGLIQGMVPWIFALGFWYGSKLMIEGRCTNREFFTVLIAILFGAQSAGQIFSYAPGMGKAKQAAANVKKVLDTFPNVIDIESEEGAIVDPSEVKGGIEFRNVTFRYPTRMEVPVLQDLNLTIKPGQYIGLVGASGCGKSTTVGLIERFYDPLSGEVLLDGVDIRNLHLRTYRQALALVQQEPVLFGGSIRDNILLGSIDEVSDDEVIEACREANIYDFVSSLPEGLDTLCGNRGAMLSGGQKQRIAIARALIRNPRVLLLDEATSALDSESEKAVQEAIDRASKGRTTITIAHRLSTIQNCDVIHVFEGGKIIESGKHDELLALGGKYYDLVQLQGLESQN

SEQ ID NO: 115 - protein, 1567 aa, Saccharomyces cerevisiae
MTAEESSSQSSVDIRDGEKSGGRIPSTPDVSNYSPGIDGESEHRPYFGLENDIQEQQHIQKLARTLTNLSMASRNSSGAHIPAGSHKAEDHDSIAEAAKSITNDTLQRSLSRASHTLEGGPVDVPFDENARELDPRLDPDSPEFDSKFWVQTMHHLFNSDPEYYKPMRLGVCLKDLRVSGVSNDADYQITVANVPLKVYEKVKSWVTKRDESRYFDILKPMDALFEPGRVCVVLGRPGAGCSTLLKTVSARTYGLTVRPESVISYDGIDQKTIVNHYRGDVIYSPEIDFHFANLTVGYTLEFAARCRCPSSRPAGISREQYYKHYAAVTMATYGLSHTYNTKVGDDYVRGVSGGERKRVSIAEVSLAGAKVQCWDNATRGLDSATALEFVRALKTNASVTGTTPLIAIYQCSQDAYDLFDDVLVLYEGYEIFFGTADSAKDYFVDMGWECPPRQTTADFLTSITSPSERKPRPGFEKTVPRTAEEFYDRWRSSPEHAELRNRIDAYLNKHSNGQAAQTMHDHHTARQSKHSKPTSPFLISFGMQVKAVMDRNWQKIKGDPSVYCFNIISNCIMALIISSMFYNQKANTGSFYYRTSAMFTGLLFNSFSSLLEILALFEARNIVEKHKTYAFYRPSADALASIMTEMPSKFLIAVGFNLIYYFMINFRRSVGHFFFYFLIALTSMFAMSHLFRTVGSACVSLQQAMIPASILLLILSIYVGFIIPKGNILGWSKWLYYLNPIARSMEAMVANEFAGREFECSQFVPSGGDYDKLPLQNKICSVVGSEPGKSMVSGTKYMRLSFDYRNGHRWRNWGIVVCYAAFFLGTYLLLIEYNKGEMQKGEMTIFPRSTLKKLKKKQGLKNDIESNDSLLKDETVADSHDEKSHSSSGDGAVEGIGSDQVVFWRNICYDVQIKSETRRILSNIDGWVKPGTLTALMGSSGAGKTTLLDTLANRVTTGVITGDVFVNGRPTDESFQRSTGYCQQQDLHGRTQTVREALTFSAYLRQPYKVPKKEKDEYVEKIIDLLEMRSYADALVGVTGEGLNVEQRKRLTIGVELVAKPKLLLFLDEPTSGLDSQTAWSVCQLMRKLASHGQAILCTIHQPSAILMQEFDRLLLLQKGGRTVYFGELGKGCSKMIEYFESKGSEKFPPDCNPAEFMLHVIGAAPGSHVTTDYHQVWLESQEYQDVQKELGELMKRANQPIEDNDEDLHKEFATPFWYQLMIMTKRVLEQHWRSPGYIVAKLWTVAFSAIFIGFSFFKANNTLQGLQNQMFSLFMLMMIFNPLVQQMLPQYTDQRELFEVKERPSKTCDWKTFVLAQLLAELPWCLVTGSLAFFCFYYPVGLYRNCPDHYQLHERGALFWLICVSFTLFTTTFGQVCIAGLERRENAALVANTCFMMCISFCGVLVSKEHLPGFWKFMYYISPFTYLIAAMMATGISNTEVICAKKEYLHFPPPNGQTCGKYMKAYMEKAGGYLLDENSTTECTFCTMSQTNAYLKTLDIHYSQKWRNWVIFTCYSIFNVFLFVLLYWLFRVPRDHVFFKKLAGKKEEWVASRKKKKDAKDAANQV

SEQ ID NO: 116 - protein, 701 aa, Calathea utilis
MDGSHFPMTSTTGEPVLSGKKGKRRKVIKSCAFCRKRKLKCSQARPMCQQCVIRKLPQCVYTEEFNYPLSNTELFEQVPNVALVQKIENLQTLLKENDNNNAKPVYCRSSENPLRSLRTSVLGDNGSRYVFGPTSWKTLSLFEQNKFQTEFQNLWKVLKPLPECTKSQLNENDVVADLPSFPQMESCIKSFFAGPLFDILHIFNQDDILSLLDRLFIRDTTDKNLVILLDLQGNAKDKYNLGIVLQILCLGYYNQDIPSSVSRFLHSLSAASLSSSSSNFVEKLQFFLLSYISVMINCTDGVWDATQGVDLINELCQGCISLGLNDIDKWYLNESEETKQNLRCIWFWALFLDVSTSYDIGNPPSISDDLFDLSIFTAQNFQSPSIDFRRVKLMHDFLDVSRFTTREIHKREMNEKLTTFSLRLIEFIQSNFSPIEHYTNSVYYSDIDPFDILILSRSLSIVASIYNIEMIIAQQSRIIDKNRMVQFLLISISVCVNTMVFHFKEPINDQENVLTEGLKLSIILINPLLIRIVSQVYSLAFNRLIFREKGFLFLIDLDTGKKIQFIKYEEENFDELLTGFDVRTDKFLSFSGTIIRFYEIVDSIFAVNERNKRLLKAVSNFYQLTSTLAFERVSRVLFDKASQARIETEKIWLKKGINMEHFSDLMIEDFINDVWKTFKEISKDLWSIDKKKFYKQYHFDL

SEQ ID NO: 117 - protein, 614 aa, Calathea utilis
MSDQESVVSFNSQNTSMVDVEGQQPQQYVPSKTNSRANQLKLTKTETVKSLQDLGVTSAAPVPDINAPQTAKNNIFPEEYTMETPSGLVPVATLQSMGRTASALSRTRTKQLNRTATNSSSTGKEEMEEEETEEREDQSGENELDPEIEFVTFVTGDPENPHNWPSWVRWSYTVLLSILVICVAYGSACISGGLGTVEKKYHVGMEAAILSCSLMVIGFSLGPLIWSPVSDLYGRRVAYFVSMGLYVIFNIPCALAPNLGCLLACRFLCGVWSSSGLCLVGGSIADMFPSETRGKAIAFFAFAPYVGPVVGPLVNGFISVSTGRMDLIFWVNMAFAGVMWIISSAIPETYAPVILKRKAARLRKETGNPKIMTEQEAQGVSMSEMMRACLLRPLYFAVTEPVLVATCFYVCLIYSLLYAFFFAFPVIFGELYGYKDNLVGLMFIPIVIGALWALATTFYCENKYLQIVKQRKPTPEDRLLGAKIGAPFAAIALWILGATAYKHIIWVGPASAGLAFGFGMVLIYYSLNNYIIDCYVQYASSALATKVFLRSAGGAAFPLFTIQMYHKLNLHWGSWLLAFISTAMIALPFAFSYWGKGLRHKLSKKDYSIDSVEM

SEQ ID NO: 118 - protein, 663 aa, Calathea utilis
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 119 - protein, 584 aa, Pichia pastoris
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 120 - protein, 985 aa, Pichia pastoris
MAIWEQLEVSKAHVAYACVGVFSSIFSLVSLYVKEKLYIGESTVAGIFGLIVGPVCLNWFNPLKWGNSDSITLEITRIVLCLQIFAVAVELPRKYMLKHWVSVTMLLLPVMTAGWLIIGLFVWILIPGLNFSASLLISACITATDPILAQSVVSGKFAQRVPGHLRNLLSAESGCNDGMAFPFLFLSMNLILHPGNGREIVKDWICVTILYECLFGCLLGCFIGYVGRITIRFAEKKNIIDRESFLAFYVVLAFMCAGFGSILGVDDLLVSFAAGATFAWDGWFSQKTQESNVSTVIDLLLNYAYFIYFGAIIPWSQFNNGEIGTNVWRLIILSIVVIFLRRIPAVMILRPLIPDIKSWREALFVGHFGPIGVGAIFAAILARGELESTFSDEPTPLNVVPSKEESKHWQLIACIWPITCFFIVTSIIVHGSSVAIITLGRHLNTITLTKTFTTHTTNGDNGKSSWMQRLPSLDKAGRSFSLHRMDTQMTLSGDEGEAEEGGGRKGLAGGEDEEGLNNDQIGSVATSGIPARPAGGMPRRRKLSRKEKRLNRRQKLRNKGREIFSSRSKNEMYDDDELNDLGRERLQKEKEARAATFALSTAVNTQRNEEIGMGGDEEEDEYTPEKEYSDNYNNTPSFESSERSSSLRGRTYVPRNRYDGEETESEIESEDEMENESERSMASSEERRIRKMKEEEMKPGTAYLDGNRMIIENKQGEILNQVDIEDRNEARDDEVSVDSTAHSSLTTTMTNLSSSSGGRLKRILTPTSLGKIHSLVDKGKDKNKNSKYHAFKIDNLLIIENEDGDVIKRYKINPHKSDDDKSKNRPRNDSVVSRALTAVGLKSKANSGVPPPVDEEKAIEGPSRKGPGMLKKRTLTPAPPRGVQDSLDLEDEPSSEEDLGDSYNMDDSEDYDDNAYESETEFERQRRLNALGEMTAPADQDDEELPPLPVEAQTGNDGPGTAEGKKKQKSAAVKSALSKTLGLNK

SEQ ID NO: 121 - protein, 1068 aa, Kluyveromyces marxianus; identical to SEQ ID NO: 69

SEQ ID NO: 122 - protein, 518 aa, Saccharomyces cerevisiae
MEDKDITSVNEKEVNENTNSRIIKYDAERRATRTETSKKDKWKNIVTIIASGFALISDGYVNGSMSMLNKVFVMEYGKKNYSSKVSTRVSNAALVGIIFGQFFMGIAADYYSRKSCILVATAILVIGSALCAASHGTTVPGMFWMLTVMRGLVGIGVGAEYPTSTLSANESANEYTTTKRGGILVMVTNLPLAFGGPFATIIFLIVYKICSGTKHLEAIWRTVFAIGCFWPLSVFYFRWKTATTEVYEKGRIKRNIPYFLALKFYWKRLLGTCGTWFMYDFVTFPNGIFSSTIISSVIKDQNDLVKVAEWNLLLGVLAVLGVPIGAYLSDRIGRKYTLMFGFSGYIIFGLIIGCAYDRLKKITPLFIIFYAFMNMLGNAGPGDMLGVISSEASATAVRGVFYGLSAVTGKIGSVVGVECFQPIRDNLGARWTFIIAAICGLIGIIITYFFVPHSLESDLMKQDVEFHNYLVSNGWTGKMGFDETDEESMVRTIEVEENGTNCSKKNAEIISVRQVDQS

SEQ ID NO: 123 - protein, 574 aa, Saccharomyces cerevisiae
MSEGRTFLSQLNVFNKENYQFSSSTTKKEVSNSTVDADNGASDFEAGQQFATELDQGEKQLGILSCIGLICNRMLGTGVFAVSSTIYTLCGSVGLALIMWAVGAIIAISGLYVYMEFGTAIPKNGGEKNYLEAIFRKPKFFITCMYAAYIFFLGWAAGNSINTAIMFLTAADTEVTKWNQRGIGVAVVFFAFLINSLNVKIGLYLQNILGIFKIGIVLFISITGWVALGGGLKDGYQSHNFRNAFEGTETATAYGIVNALYSVIWSFVGYSNVNYALGEVKNPVRTLKIAGPTSMVFLAIIYIFVNIAYFAVVPKDKLISSKLILAADFFDIVFGGQAKRAAAALVGLSALGNVLSVIFSQGRIIQQLGREGVLPFSNFFASSKPFNSPMVGLFQHFIVCTVTILAPPPGDAYLLVQNLISYPMNIINFAISAGLLWIYWQRRQGKIEWNPPIKAGVFVTGFFTLSNLYLIIAPYVPPSNGESVYSSMPYWIHCVIAWGIFFFGGVYYVVWAQLLPRWGHYKLVSKDVLGEDGFWRVKIAKVYDDTIGDVDTQEDGVIETNIIEHYKSEQEKSL

SEQ ID NO: 124 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 125 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 126 - protein, 616 aa, Saccharomyces cerevisiae
MSSSITDEKISGEQQQPAGRKLYYNTSTFAEPPLVDGEGNPINYEPEVYNPDHEKLYHNPSLPAQSIQDTRDDELLERVYSQDQGVEYEEDEEDKPNLSAASIKSYALTRFTSLLHIHEFSWENVNPIPELRKMTWQNWNYFFMGYFAWLSAAWAFFCVSVSVAPLAELYDRPTKDITWGLGLVLFVRSAGAVIFGLWTDKSSRKWPYITCLFLFVIAQLCTPWCDTYEKFLGVRWITGIAMGGIYGCASATAIEDAPVKARSFLSGLFFSAYAMGFIFAIIFYRAFGYFRDDGWKILFWFSIFLPILLIFWRLLWPETKYFTKVLKARKLILSDAVKANGGEPLPKANFKQKMVSMKRTVQKYWLLFAYLVVLLVGPNYLTHASQDLLPTMLRAQLGLSKDAVTVIVVVTNIGAICGGMIFGQFMEVTGRRLGLLIACTMGGCFTYPAFMLRSEKAILGAGFMLYFCVFGVWGILPIHLAELAPADARALVAGLSYQLGNLASAAASTIETQLADRYPLERDASGAVIKEDYAKVMAILTGSVFIFTFACVFVGHEKFHRDLSSPVMKKYINQVEEYEADGLSISDIVEQKTECASVKMIDSNVSKTYEEHIETV

What is claimed is:

1. A yeast cell genetically modified to produce one or more human milk oligosaccharides, wherein the yeast cell comprises (i) a heterologous nucleic acid encoding a human milk oligosaccharide (HMO) ABC transporter polypeptide; and (ii) one or more heterologous nucleic acids that each independently encode at least one enzyme of a human milk oligosaccharide biosynthetic pathway.

2. The yeast cell of claim 1, wherein the ABC transporter exports the human milk oligosaccharide 2'-fucosyllactose.

3. The yeast cell of claim 1, wherein the ABC transporter has at least 95% identity to any one of SEQ ID NOS: 1-27.

4. The yeast cell of claim 3, wherein the ABC transporter has at least 95% identity to SEQ ID NO: 1, SEQ ID NO: 2, or SEQ ID NO: 3.

5. The yeast cell of claim 1, wherein the one or more human milk oligosaccharides comprise 2'-fucosyllactose, 3-fucosyllactose, lacto-N-tetraose, lacto-N-neotetraose, 3'-sialyllactose, 6'-sialyllactose, and/or difucosyllactose.

6. The yeast cell of claim 5, wherein the enzymes encoded by the one or more heterologous nucleic acids that independently encode at least one enzyme of the human milk oligosaccharide biosynthetic pathway comprise one or more of a GDP-mannose 4,6-dehydratase, a GDP-L-fucose synthase, an α-1,2-fucosyltransferase, a fucosidase, β-1,3-N-acetylglucosaminyltransferase, a β-1,3-galactosyltransferase, a UDP-N-acetylglucosamine diphosphorylase, a β-1,4-galactosyltransferase, a CMP-Neu5Ac synthetase, a sialic acid synthase, a UDP-N-acetylglucosamine 2-epimerase, a CMP-N-acetylneuraminate-β-galactosamide-α-2,3-sialyltransferase, and an α-1,3-fucosyltransferase.

7. The yeast cell of claim 1, wherein the enzymes encoded by the one or more heterologous nucleic acids further comprise a protein that transports lactose into the yeast cell.

8. A method of producing one or more human milk oligosaccharides, the method comprising culturing a population of genetically modified yeast cells of claim 1 in a culture medium under conditions suitable for the yeast cells to produce the one or more human milk oligosaccharides.

9. A fermentation composition comprising:
a population of genetically modified yeast cells comprising the yeast cell of claim 1; and a culture medium comprising one or more human milk oligosaccharides produced from the yeast cells.

* * * * *